United States Patent 7,745,391 (HUMAN THROMBOSPONDIN POLYPEPTIDE) - sequence listing, part 34

SEQ ID NO: 77497 - DNA, 2841 bp, Homo sapiens
  misc_feature (1)..(1): n is a, c, g, or t
  misc_feature (6)..(6): n is a, c, g, or t
ngcaangctaaatccagaatcgtttcaattactgtgaggggaattctgaagttctcattaaacacacgaatgtctcaagctttgaaaagagccagatgccaaaggcaagaatcccagggcattgcccacctgggtgtgatcccctgataattgtctaacaaattcagcatgtgtcccctgggcatgaccatctgctgggaaaagttccaggaccctgagacatcttgggattcctgtggtttaggaaagacctttaactaccagctggtagttgtctcagcattcttcaaatagtccggtcttgtttaatattattattattattgttatttaattttattttattgcaactgtacttagagaatagtctggtcttgagaccttttcactgtggtctgttctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcagaaggccttccccaggaggcctccaacagatccctgaatgccacagaaacctcagaggcttgggatcccaggaccctccaggcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggaactttggccaaatcttgtgtgacatctggctgtcctctgacatcacgtgctgcacagcctccatcctgcatctctgtgtcattgctctggacaggtactgggcaatcacagatgccctggaatacagtaaacgcaggacggctggccacgcggccaccatgatcgccattgtctgggccatctccatctgcatctccatccccccgctcttctggcggcaggccaaggcccaggaggagatgtcggactgtctggtgaacacctctcagatctcctacaccatctactccacctgtggggccttctacattccctcggtgttgctcatcatcctatatggccggatctaccgggctgcccggaaccgcatcctgaatccaccctcactctatgggaagcgcttcaccacggcccacctcatcacaggctctgccgggtcctcgctctgctcgctcaactccagcctccatgaggggcactcgcactcggctggctcccctctctttttcaaccacgtgaaaatcaagcttgctgacagtgccctggaacgcaagaggatttctgctgctcgagaaaggaaagccactaaaatcctgggcatcattctgggggcctttatcatctgctggctgcccttcttcgtggtgtctctggtcctccccatctgccgggactcctgctggatccacccggcgctctttgacttcttcacctggctaggctatttaaactccctcatcaatccaataatctacactgtgtttaatgaagagtttcggcaagcttttcagaaaattgtccctttccggaaggcctcctagtcttattcggtgatgactcttgttatcttttgtgtcctgtaacctcatcgggattgtcttttttttttttaattattttctgagacttggattaattcatggtatcttgagtcttggttcaatcaacagaattgttctttttcctgttgttttcttaacttctgaaagagctgtgggtggtggggggcggggggcaggactgaagatttcactacttagcataatattttctttctttttttttttttttgagacggagtcttgccctctcgccaggctggagtgtagtggcacaatctcagctcactgcaacctccgcatcccgggttcaagagattctgcctcagcctccagagtagctgggactacaaacgtgtgtcaccaggcccagctaatttttgtatttttaataaagacggggtttcatcatgttggccagggtggtctcgatctcttgacctcgtgatccgcccgcctcagcatcccaaagtgctgggattacaggcatgagccactgtgcctggccaacataatgttttcacagttcctctttgttggaagaagtgtgtgacctacaagattcctggttgatacagttcaggtgagaaactgtttgattatagaaaagaccccagactcagagggaaggctctctggtctacctgagatctatatggagcttaaaggagggtgaataagattaatgacctgaattgaaagagaatttggagccaggatgggtctccattctgtgtggcaccttgattggaaaataatatccatgcgtttcttccactgagtctttcttagattaaatctctcccagttgtccgtgaagagaaagacagtatttgcagtgccgatgatatagagtgacttggagagagattcagaagttaggggtagcgggggtaggatggttgggaccagattgactaccctgtacccttccttcttccccaatatgcctgcgccatcttcacattctgaagttgaaacccatgatcacccctttgaggtagattgaccggctttagacgcccaccccccacccaccgcaagctttgagtgggacaccattctgaattttttttctgaatttttttttaacatctctttctcattagagatctgaaaactcattagagatgttgagtcttatcaaataaaaagcatgagacatcatggcc

SEQ ID NO: 77498 - DNA, 369 bp, Homo sapiens
gattctcgctctgtcaccagactggagtgcagtagcatgatctcggctcactgcaacctccgactccctggttcaagcgattcccctgcttcagcctccccagtggctgggattataggcacatgccaccatgcccagccaatttttgtattttagtagagacagggcttcaccatattgtccaggagggtctcagtctcctgacctcatgatctgccctcttcagccatccaaagtgctgggattacaggcgtgagccactgcaccgggccaggattttttttaatgttgtgctaatatggtatattctgatggccagctcaaggaatgacacattcattacctatttccaggggctcagaggcagag

SEQ ID NO: 77499 - DNA, 5556 bp, Homo sapiens
ctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttc

SEQ ID NO: 77500 - DNA, 5498 bp, Homo sapiens
ctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggatggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttc

SEQ ID NO: 77501 - DNA, 324 bp, Homo sapiens
gagtgtccagatgatggcagtgatggcccatctggagcggctgctgtaaggacactggctgcagcaggggaggcacagccaggcctgcgcactaggcagagctggtgtgggagccaggagcagatgagagccccgccttctaccaagttggcagtgcagaaggccgcactcccgggtgctgatgccgagttcagctccagaccctggcatccctgggctctcaggggcccaggaagcccccaacccctgcaggcttcaaagggcctgctcccactccttggcctctccctcctcctggcaaccattctggggcagagcaaagct

SEQ ID NO: 77502 - DNA, 97 bp, Homo sapiens
atgagaagtgccgttgcctcggcaaccccaaacccagtccaagcccggagagggggaagttcggggcgagtcccgggggcggtgcgtggcgccggtt

SEQ ID NO: 77503 - DNA, 569 bp, Homo sapiens
gctcacgaaatctaagtcgaggagaaatgtaaagcataactgaaaagcgtgcggtgtggaaagcggagtgctgaaagacaacgactagcgcgcgttccagaccaagagcaacttcaacaggacaacgaggaggaaccacgcgcaagcacttacaaatgcgccgcggtttctatcccagagccgccaacgggaggccgcccggggccaccaacctgctctggtccagggaggtccgtgcctcgcccttcggaccggacatcaaacttccacattttaacttttaaatacagcaggaagtatctcccatgtattatgctcctaaaccatcacattcttaagccacgtatgactggaagtagtgagggccaccatcaaattgattccacccagaacaagatcccgaagaaaagatccactgagtgcaaagttcacacccctagaatttggggaaacagcctattggtttctctcacaacaaatgatctgttaaaaaagttacaagggtatcaatacaagtaaaattctatctaaaacccactgaataaaatgagaatccgtgagtccagcct

SEQ ID NO: 77504 - DNA, 449 bp, Homo sapiens
tttccgttcactccagcccatcggatggcgtgcccaccttgtccttgggggctctgtgtcccctgggctgctgcccactgacttgcacgctccacgtccggcgggacaggtgcccgcacgcctggaacatggatgctccctgctctgaacatccatctgccggaagatgaggcagctgaggccgcgttcacgcagccggagcggggaccacctcaacgcgacgtgagggcctccaccgagaaaggacataaacggcagacggtccagtgagacgagacgggaaatcgtcctgagagcggtgatgccgtgatgcgcgcccttcgctgagcgtcagagagaagcccaggacggttggaaaccggcattgagatggtttaattcaactccagaacgttcagatgtattgtttctaatcctccaggtctctggaaaatttgcttctggttttc

SEQ ID NO: 77505 - DNA, 213 bp, Homo sapiens
acccggaggtctgcttcactggccacttagactcacaggacaaccagagccacactggcatcagatttacttagaagagtataggataagaaacagaatcccaacagggcagcttcttatcttcagtgggagcccttgcagtggtctacatagcatccaccaaattgactactacctgccctgagtgacagcttagctgtgggtgcaggatcc

SEQ ID NO: 77506 - DNA, 401 bp, Homo sapiens
atgctaaagtcaccatggtgacaagaagaactcagctggcttcctattcaatgcatctcagatgaaggtgctcactccaggaaacataaaggatatccattaatttttagctttttttgtgtgaagcaaagggtattgctaatatacaacctctggaatagacctgatcagttacccagtctctggaagagggtggtaattgaaaaactaataagggcaggccctagtctaagaaactaaatctaagacagccacctgaagtgtgaagatggaaattgcagagttgagtctggagtgttttataggcttatagctctaacttgcctaattgaacttttacaattgaacttttacaaagaaagtggggatttatttatactcctactctagggggccacaaa

SEQ ID NO: 77507 - DNA, 2012 bp, Homo sapiens
  misc_feature (1308)..(1308): n is a, c, g, or t
  misc_feature (1578)..(1578): n is a, c, g, or t
gaattctagagaatcctgaagaagactgtgcttccaccagtttgcacagcatagataatatgcttggttgcataattcatatgagaattaggtttttaagatgttaataactaagtaagttttaggagtctcattgtgatcatggtatcacggtattagtagatgctggtgttattttgtttgattttgggaaatgtattaatatatgtgtcaaacaaggaactgaaaactattacactttgtatttttgcttttgtcatcataatcatgttgaatttatgtaatcattgattttatttcatgtggaatagctaattgcttcttaaaattatgttatttaatgttttcattagctacactctacaatccacataacaccttttattttaaaattacgtaaatatatgcagaaagtagaattttttattaaaatacttttatgcttgaaatatgagaaccaagtacagttttctattcaaaattttcttattttaatactgtttggctaacaaagatagataaagtttcattcaaacacttttctccttaaaatttcaagataacgtacattaacttttctatgtctaaccctagcttatccttccctgttataaagttgattgcttaaacttactgagaaaatattcccatcattaacaaaaataaattattgaaataaaaaaggatagaggttcaacatatttagtcattatggaagtgcaaatcaaagtcatatgccacttcacaccaaccacatttgtcaaaataaaaaaaaaaaaacaggaaataggaattgttgataagaatgtggaggtattggaacccctgtacattgctggtgagaatgtaaaatggtggtgctaccacagaaaacacattggctctttgttaaaatgtaaacataaaatttccttacaagtcagtatgagtacttcttaattgtatacctgagataactgaaaacatatgttttttaaaataacttttgtccagatgttcatagcatcattttttactgtagttgaaaaatggaaacaaactaaatgtccatcacctactaaataaaatgtggcatagccatacaatggaatattgtaaatctgtgaaaatgaatgaacaaattacataagggattaacctcaaaaacattatactaagtgaaagaagccagatacaaaaggccaatattgtatgattctatttttgtgaagtgcccagaataggcaattttatatggaaagaaagcagagtagtggtttccaggggctgagtgagggaaaatggggaataaccacttaatgtgtacanagtttctttttaggatgatgaaaatgttctagaatcagtggtaatggtaataaaacattgggaatatactaaaagccactgaattgtaccctttaagatggttaaaatggttaattttatgttatgtaaacattatttctctaataaagtagattttcagcaacaaagggcccattagaatggaagcatactctgaagggttattagttatcaactcctaacatgcaaaatatttttaggtagcatttttatatagaagaaattatattnaggcatattaagcattgagtgtcattattattgatgtataatggattcccatccaacattatggtgtgattttaaaagaagagccaggaaatcaaaagtattttctctggggcttaatctttgatcagatcattgaaaaacttatggcttccagatttgtgggggacagatacttttactcattatccaatgctctaaggccacccagagagactggattatctacattgactattcacatttccttagatatatttatttgaatgatggcttctacaaagtagagaagtctgtcattatgagagataaagccagctgggcttctgggttgggtggggtcttggagaacttttctgtctagctaaaggattgtaagtgcacccatcagcactctgtaaaaacacaccaatcagcactctgtgtctagctaaagg

SEQ ID NO: 77508 - DNA, 362 bp, Homo sapiens
actctgttgcccaggctggagtgcagtggctgcaatctcggcccactgcaagctccgccttccgggttcatgccattctcctgcctcagcctccccagtagctggaactacaggcacccgccaccatgcccggctaattttttgtatttctcgtagagatggggtttcaccatgttagccagtatggtctccatctcctcacctcctgatccgcccaccttggcctcccaaagttctgggattacaggcatgagccaccgcaccaggcctttttcaactcttgataaggtcagccttttccatcttagccatcctaacaaaagtggttttactttgtatctacttaatgactaatgatgttg

SEQ ID NO: 77509 - DNA, 347 bp, Homo sapiens
ctcaccgaggcagtacctgaagggcatagtaagcttagacatgaggtaggcagtgggcactgacaagagtgctgagctgacttttgggtccagtagaagcagtaataactaagtcttgcagaatgcagtcccaggcagtaacaccctcatccctcggggtgggagtgggagtagtaaaaggaggggcctggggaatatgctcgtggtggtggtcaggcaaagggtgagagatacaaggaaaaaggcccgtactagagagaacccagcaagtggggatcaggtagaagcagagcatgggaggagagcctgggcccccactccaacaccccacatacctggtctgctgt

SEQ ID NO: 77510 - DNA, 879 bp, Homo sapiens
  misc_feature (401)..(403): n is a, c, g, or t
  misc_feature (407)..(408): n is a, c, g, or t
agctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtggtggtgctctctcacgagtgtgcccacagtgcaaaaaacgcgaatcttcaggtcttcctggggaagcataaccttcggcaaagggannnttcnnaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacattccacctggtgtcccgtgaggagtgtgagcatgcctaccctgggcagatcacccagaacatgttgtgtgctggggatgagaagtacgggaaggattcctggccaggggtgattctggggggtccgctggtatgtggagaccaacttccggaggcttgtgtccatgggggtaacattcccctgtggatcaaaggagaagccaggagtctacacccaaggtctgcagatacccgaactgggatc

SEQ ID NO: 77511 - DNA, 825 bp, Homo sapiens
  misc_feature (347)..(349): n is a, c, g, or t
  misc_feature (353)..(354): n is a, c, g, or t
agctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgannnttcnnaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacattccacctggtgtcccgtgaggagtgtgagcatgcctaccctgggcagatcacccagaacatgttgtgtgctggggatgagaagtacgggaaggattcctggccaggggtgattctggggggtccgctggtatgtggagaccaacttccggaggcttgtgtccatgggggtaacattcccctgtggatcaaaggagaagccaggagtctacacccaaggtctgcagatacccgaactgggatc

SEQ ID NO: 77512 - DNA, 236 bp, Homo sapiens
gctgggagtgggggagggaagatcagcaggatgctcaagttccagtgaatggttcttggttatagagcacaagcttgcactcacacgaactctgttgaaactctgttaaagccaaataagcaaattacctgctttcttcttctctggagtgtgccttctgtgtaataaggcactaaacacacatgcctgatgaaatctcctctgagaaaaaactggtaattctgttcttcaggaat

SEQ ID NO: 77513 - DNA, 416 bp, Homo sapiens
tgaacatgtgtgagcttttctgttctttacataagagatggaatgattggaccttagagtacatcttcagtattattaggtaattccaaacagctttccaaagtcgctatatgaatttacacccacactagcatcataagcattcccattgcttcacatcatggtcagcacttcctaattttgccaattcgatgttttattgctacaagaaatattttcctaattactagtatagttgagcattggctttaattttttatctttaacattgtgttggagatagtagctaatggaaatagaaagcaattagaggcacaggaattggaaaataagtaaaaccatctttttttgggataatatagttatgtatcaagaaaatccaaaagcatccatgagaaaactactacaaacaaaat

SEQ ID NO: 77514 - DNA, 339 bp, Homo sapiens
acaatattgaagtattaatgcattcttaaatgatcttcaaatatgatcattatatctagagatattccaaaaatattcagtgaaaggaggaatcggtcttttttacctagtatcactgccatggaaagacgatatcactggatgggtgtcctggcagctctttctttcctggaacattgcacatgccctgctttaaatgaaggaagcttttactttaggcacttagtgttttttgaatatgctttctcatcctttcacgtgataaaattgatgttagactgggaacaatctagatccctttgacaggatatgccagaggtgggaagaaaaagtggttca

SEQ ID NO: 77515 - DNA, 487 bp, Homo sapiens
tttgtactctgtccctttatttctcaagctggccgacgcttaggaaaaatagaaaagaatctatgtgaatatcggggcaggttccccgataccaggagacagggataagaacgtccaagccatgctgttcacgagagcaaagctagcaaccactgaaatcgtgcttagcaggaaagagatggtcacgctctgaaatatcaggcagcagccagaatgaatggccggcagtcatgcgcaacaatatggatggatattagggatctcatagtaagtgaaaagtacaaagaaaagcccagaataatcacattgcatatttcaataaattaaaaacaagtaaatcggccagttgcggtggctcacacctataattccagcacttggggaggcggaggctaggagttcgagaccagcctggataatatggcaaaacccgtctcataattcggtctcaaaataaatgaataaataaaacaagtaaataaatata

SEQ ID NO: 77516 - DNA, 940 bp, Homo sapiens
tatgaaacaatacagttgaaaatgcaattttctgaatgtctgacttgatttgagcgtaaattttagactactgggaggaaggatgggcttacggtttcttcagggaatcctccatgactggagatcatttacttgttctctgtggcacctttcaatcattccacatcctggcatacatagaaaatgatacatttgccagtgtaaacttatgctaaggggttgtctgtagccagaagataactgtggctgggccccagtttccctaagaccccctcacctccacctcttccagggctgagtggatccatattttagcacatcatccctaattctttagtgttagtgtcccgcacagacactgggaagcttgaactctcattcgtaaagtttttcaagatgcctgtattgagtttaaatttctgtgaccttttgtgatatttatatagatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacctctgtggttggaacaatcctgtattcttgtggtttcatgagaagatgcaaagaaactgtggcaggctaacatgtaccttgtaagctgcaagcttatatgatgtctacttatcctcttaacagtaaggctgacctactcgttactttctgagagaagaataattttcttttgtttcactgtgtactgtttttataaaataaacaataaaatttgatcataaaa

SEQ ID NO: 77517 - DNA, 668 bp, Homo sapiens
tatgaaacaatacagttgaaaatgcaattttctgaatgtctgacttgatttgagcgtaaattttagactactgggaggaaggatgggcttacggtttcttcagggaatcctccatgactggagatcatttacttgttctctgtggcacctttcaatcattccacatcctggcatacatagaaaatgatacatttgccagtgtaaacttatgctaaggggttgtctgtagccagaagataactgtggctgggccccagtttccctaagaccccctcacctccacctcttccagggctgagtggatccatattttagcacatcatccctaattctttagtgttagtgtcccgcacagacactgggaagcttgaactctcattcgtaaagtttttcaagatgcctgtattgagtttaaatttctgtgaccttttgtgatatttatatagatgataggttgtacatagttatggagctgatagaaggagccccgcttggagagcatttcagttctttgaaggaaaaacatcaccattttactgaagaaagactatggaaaatatttatacaggtatgcttttatcttcattaaatttttcttaaaacagtaatgttctgagctggcttcttaaagacgtgcagtagtcatctttggctatatgtatgttggg

SEQ ID NO: 77518 - DNA, 407 bp, Homo sapiens
atgttgatgtctgccactgtaatcacaattaaattggtggcaataaagagttctccacaagtatctctacactcgtcatcccatttattcccccaggcttcttgttcttgatccttcatttacattgtccaacagttttgatacaagctaaaaaaaagtgaagtgtccactgcaacccccacatttgttatatttttaaagataataataatatgtgtgtttctaggcatctttgtttttaaggactctccttacttcagggaagaatctcaccacaatgcttgctgcaaacacctgcagacatctcacattttattaatttcaaagatttgtttaaattaagttgatgaaattaattaaattgaaaacaaatgcacacaaaataaacttattggaacctttgaata

SEQ ID NO: 77519 - DNA, 806 bp, Homo sapiens
tgaagaaaaaaaatatacctccaaagaaaaaataccttcaatctgtcattcctccagatacttcttgagcaaagtctttgtgtatacaaatacccaccattaatgactgtttctcttgtgtttcccagcagcagtgttctccaatatttttaagtttctggaaaaaaatgcgacagttttataattattgacaacttctttttaatatttgcttctttaccatactctgagcttctaaaggttaggggtaggttatagtaggttttcccactatattcctagtgccaagcttattgccagtattgtataactgacactatatatatatttgttgagtatctgcagacaaaaataaaatttttttaaataaaaaattcatacctcatttaatatttttgtatgagaaaatagaatttttttgtctcctaaatgaaaaatttattataatctataatgtacttctgagactctcgttcttatgttgccttgaggttggggatatgtgcctctgtgtactgtttctgtttctccaaccccaaactaacacacacacactctctctctctctcccctccctacctcctgtgaataggggcattgataataaaggagcctatttttactgattataattagaaataaagtttcttcgcatctcagaagagttacataatgggaaaaatgaaactatccatcttgtggatcagggagatgttttggttattctgccaacctcccactgggtctagtcttaactcctttccagtttatagtgttccactttgaatactgctttaatcatgccc

SEQ ID NO: 77520 - DNA, 513 bp, Homo sapiens
gcacatagtagttgaacaataaatgtatagttgctgaatgtgtgagcaaatgtcgagtttttcagatatctgagttcaatatgttaaatagtgtaaatgtattaacgtgctagaaatttttatagacaactcaaaatttttcacttttgaaagaatgtagaagtatattgtcaaaactaagagaaactcaaaaggaaataacaagtcataaaattccacaactttttcttaaaatctgcattctaaattcattggtttaaaacattaaaatttagagaacagaataattgattatcgttcagtaaataataatacagttttggatatgtgaagttctgttttcatgatagtttaaaatttaccatcttaaccatttttatgtgtacgtttcagtagtgttattatatattcacactgttggacaaccaatctgcagaactttttcactttgcaaatctgaaacactgtattcgttaaacaacactatttccacttgccctcagtccctggcaa

SEQ ID NO: 77521 - DNA, 349 bp, Homo sapiens
gatggtcacgggtgtttattactggacatgctctatgcttacttgcttgaaaacgctccattagaaaatgaactctgaaaactatatgcccaatgctaatagtgggtatttattggtaacactctttatcaggtgctatgattgttgatggctttattttcttcttcatattttctataatttctacaatgaacatgtatgtataatcagacaaaaaagccaagaaacatccataagtttttctggtcattcattcatcccataaatacttgctgagcacctgctgtaagccaggctccgagccggctgctgggtagagtgccgcaccccagggaacgctcagccctcg

SEQ ID NO: 77522 - DNA, 655 bp, Homo sapiens
agcggaaaaaattacagagtatattgattaaaatatattctaacaaaatactgatgtatagggatttaaaaaatcctataaaatgtcatcttgtctgtaaaattagcctgacaggaaatttaaaaaagacgttatctacgtatttttgaggaaaatgatattcttcatgttttaagagtaaaatataagaaatacattctcaaaaacacaagaattatgaaaagatagaattttcttaaaaaatggttttaaacaagtaatcatgctaatacatttaagaaattacaaaagagcttttgtgttatgaaatatctgataatacgtattttgttaacctcctcaaaatatgtggttgtctctatgagttttgtgtctcttccatcatatataatcaagctgtagtgtgtctggcagaattctccctaaggatgtattttatattaagttgaaccatgtgaagttgccgtctttgaaggtcaaaaatgattgaattatagacaattcatgagattccatcatatagttaaaaaatatcacttctatgttgctgaaataatttcagccatctttgtcctttttttatcttttaggtcatattttcaaatatatccttgtaattgtattcttaacactactatattttcatgacatccat

SEQ ID NO: 77523 - DNA, 747 bp, Homo sapiens
ccctgcctcagcagcgcccctcactgccccatctcccagggcttacagtccccaccccctgcatcgcccagcgcctgagaggctgggctccgggtacctcccaagagacaagaggtgtgtcccacgccctgtgcagtgagaagccctggaactccaggaccctgcttttttaggcagaatgctatggatgggccactccaaagagaaacgcggctggggccttctcactggggttgcaggccgtgggatggtgtgaacactccatgtttattcacatcttggaccccccaacccccccaagggaggggtggccttgtctttgcaagaaggcttctgagtccttagaggtgaagctgtgtcctcattccactccccactgatacccaagccaacaaggagatgccctgacccactcatggccaaggacactcatggaaaaggccttcgtcctctcagtacagactgtgccaggcaggccaggaaaagccaagaaaatatggatggaacagataggttcctagcaaaatactaaagctgagccaaagtagaaaacttgaattaactaattgccaaaaaaaaaaacagattagagaggtgattaaaaagctaccattaagaaagctctagatggctccagatcacagctgagctctcaccaacctttagagatcagataatttgaaagttaattacaatcttccaagccacagaaaaagattaaaaacctcaattcactttaaaaaaaaa

SEQ ID NO: 77524 - DNA, 792 bp, Homo sapiens
cttcgagagacgcacggacatccccgaggccgaggatgtctatgccacacgccacttccaggctggtggggacgtgttcctgtgcctcacacgctacattggggactccatggtgaggctgggcctgggggcggggggctggcttttcagcactgacccaatcctgcacactaagcctctaaactctgacctaccctcacatgccgacctttgaaccaggaccccaccccacactgatgccaagactctgaccccctcaaggctggctgactccgaaccactccccagtccccgacactgatgctggccccaacatcctgattctacccccagatgctggctctgtgactcggatgcattccagacttcaccacagccacacctgtccccaccctgacactgagcccccaaggctgacgctagggttaagcactgcccactgtttctggagtgaggtgcaggcaggggagggttctgagtctggaagggccctgatctgactcaggtgttcacaaggtctctgggtggggaacagactgggggagcagggagaggagcctagaggccagggaagaggctgccaggatggtccaatcaggaggggatggagttcagccagaggcggtgggagaaatgtacaactgtagaaggtgaaactgacagagtccatggctgagtgcttctgtgtggggcgtgagggcagggaagggctcagaagcactccatgtgtgtggccgcaacaggtgggtggtgactatatgacgataacgaaacgtatggagtttggggacc

SEQ ID NO: 77525 - DNA, 270 bp, Homo sapiens
ccgagcagcagataaggacacagcccagctgacaccttgatctcagcctcatttgaccctgaaccaaagacccagcctcccaggctggacccctgacccacggaaacaaaaggtcatagaggcgtgtggctgtgagccacattcattatccagagatagatacagcagcattaataaagccgctgcatgtccagcacctccccttccacctccgtcaagtacggggaggtggctgagggtctcaggaacccctactgaggggggaaatga

SEQ ID NO: 77526 - DNA, 784 bp, Homo sapiens
tttagagagcacctaccatgtcccaggcactggggtgcgaaagttatttggcaaaccaaaccatatttccaatgctttgggaaagttactatttaaaggagttgtaagtcaagggatgatgccctgacttggtatctttatgcaaatctgtattatccagctttggtgttgctgaaagcgggctctggccaggtgagaaaagccaggatggtggctggactgctgggcataattgccagttcttgagcacagaacaatgcctgtccatagagggctggaagggctggggctgacctccttgtccttgcccctgggctcactctgcatggagggcattccaggagagagttctggaccaggcccatactgagtggcatcaggcacggggagccagctgattgcccaggagggttcacctggctgcaggaggacaaagcagtgagctggctcaccaaggcagcaccacttccaggctgggcctcctggaggcaggcagagagtgagaggaatcacagcattaggactgggagggactgagagaggacagcaccctggatgagcttgtggaggacagctgggggcaaagtattgccttggagattaattattaatcctgtttgggcattgcaggaaacaagccacggtgcccccacatgcttggttcaaacagtgtacaggttctagggtcctgtctagctttatgaacaggagcaaatcctttccagcatgagttggactgaaaaacagagtcaggatcggagcatgcttcagccaagacctaaaa

SEQ ID NO: 77527 - DNA, 597 bp, Homo sapiens
agtacaaaataatatcttatgtaataaatttgcaggtgctcaaaagagtgggaacgagccacaggataacgtctcagagacctaaccacctgacttggttagcgagtacagctttttcaaagctcagccaagatactaggggaagtagcctgagaaggtttattatctctgtcctgatttgtgttctactgccaatgttttgagcatggagcaagcactgtgtgtgattcaaaaacatgccatatgatttaaaattgtacccatcaactctagtaattactgtgggagcaagaagccagcagtagcaatgacagcagcaacagcagtaggatgaatccctgcttcaaagagtttgaaggaagaaaggcacactctccgaggtacttccttctgcaggcttggtctcctcatcctcgagccacacactgtcagttctaccatgtgctaggaggtcctcctacctcccgctgccagctccttcataacaaagaaaatgaatccgtgaattacagctggttgattggcatcctgttgctaggaaactataaaacgaatgtatcatatttcataataaaaatgtctctgacccattcctac

SEQ ID NO: 77528 - DNA, 802 bp, Homo sapiens
caaaaattagccagatgttgtggtgtgaccctgttgtcccagctacaagggaggccaaggtgggagaattgcttgagcctaggaggtcaagactgtagtgagctctgatcacactgctgcactccagcctaggtgacagagcaagaccctgtctcaaaacgaaacaagaaacccattattcgtgaaaggctatcttgccccagagtctggagatacagtgatgagcaacagacattccttaccctcatggagccaatattttagttgtaaaaataagcagggcaggaaaattaagtaattatatttttaagaaattattttcatttatttattttttttttaaagatagagatgaggtcttactatgttgcccaggctggtcttgaactcctggactcaagtgatcttcctgcctcccaaagtgctgagattacaggtgtgagctgctgtgcctggcctaaaattaagtaattctaaaagatgataatgccttgaaaaaaattaagtgttgagatagagaataatgggaaaggaagaaggtgagggcaggtgtagccaataaactaatacttaaattaaatgcaaaggtatgagggcatctccatggaaagaggtatagaaagaatattccaggtattcagattcagaaaaggttgtgaaataaaattttaaaaaattccaagaccaggcacggtggctcacacctgtaattccagcacttcgggtggctgaggcaggagaatcatttgagctcaggagttcaagaccagcctgggcaacatagggagacactgtctctaca

SEQ ID NO: 77529 - DNA, 362 bp, Homo sapiens
caaaaattagccagatgttgtggtgtgaccctgttgtcccagctacaagggaggccaaggtgggagaattgcttgagcctaggaggtcaagactgtagtgagctctgatcacactgctgcactccagcctaggtgacagagcaagaccctgtctcaaaacgaaacaagaaacccattattcgtgaaaggctatcttgccccagagtctggagatacagtgatgagcaacagacattccttaccctcatggagccaatattttagttgtaattccagcacttcgggtggctgaggcaggagaatcatttgagctcaggagttcaagaccagcctgggcaacatagggagacactgtctctaca

SEQ ID NO: 77530 - DNA, 439 bp, Homo sapiens
atgcatagtttgttgattaatgagaagcttacagaaaaataaatgaaacaatatgtcaaagtagaggaaataggtattaataattccaagggaagcagaaatttaccaggaattttgactctttgtgagtcaatggtgaaaaatgttttacgtgaactctgatcaattctatggccaaagtcttgagttttgattccatcagaattctgtgaaatatggagatttgtatagaaggggagtcaatccctggaaattgcatacgtttcaagtattggaagacagtctcggcattcaggaagctagctggccctttgtcagaaacagagaagacagccatttatgctagaagagtggcaggaccaactaaacacatgtgcctctaatttgtaaactgagtgtctataaattaagaatgttttaaatctgttttaacaggcat

SEQ ID NO: 77531 - DNA, 865 bp, Homo sapiens
aatttattgagaatgtgggaaaacatttgttctctaaaagaaagttgcagatcatactgcaaagtgacagctgagcaaaggctcccccttgagaagggcatgtgctactcagctcatggcatctgggctctcattgataatggggggtaggttggaagattcttggaagccacagcaagacacaccacacctgggctctcataatcattttgccaccctagagagctccagacacacgattggccctctaacagaggaacattttaatacaagtgtgtactgctcaaggactcatttgctaagttaggggcagactccttggtaccaccaaatcctatttttcctaaatcggtcaatgtattgtcatatcccctgtgtgcagttttaactctgtgagtctggatttgaatggaggcccagctttattctagctgtgcaactgtgggcaagttccatcttctccaaagttagcttcctcagggtattgcaagaattaaatagcaaaatgcacataagtgtctggcgtagagtaagtgatagcttcctttcttttcctcattttaatcaattacccagttggtggatgtgataacaaatgaacttcctgaagatcagagctgtgtgttagtgtagggctcagatcctctttatgtattcagtgaacactatgttctgtctaacaggcacctgctctaggttattagggccattaaaggcatgttatattctcaaagagtatacaatttagtaagagacacagaaaaaactgatgttcgattgttaggttggtttaagttgttgatacatacttggaatgactaagatcattgtttaacattggtgagtgcacactgcaatgggaact

SEQ ID NO: 77532 - DNA, 332 bp, Homo sapiens
ccttgggtaagaaaggatgaattaatgcctctccattggaagtgagtatgattgaagatgcagtgtctcttgtcttcttgctgaccaagtgaaaatgagagaatatggcccaaccactttggagagttatatagcagtacctagtaaatttcttctggtagacctggggcctactttagagaaactctcacatgttcagaaggaggtagatggaagaatattcatggcaactctgtgttaatagcaaataaccagaaacagcccaaatgtccatcaacagaaatgggctaatgaattcttacatagagtgaaattctttatagcagttacag

SEQ ID NO: 77533 - DNA, 468 bp, Homo sapiens
taagagattacttttttaaaaaaaatttttttccccttgcaatttcctgtttcaacaggaaattgcaaggggaaaaaaatccaagaacataatgtaaaaaatttaagagcccatgaaaagtcagctattcatttagtagcaccaacccagaggaaaaacatgttttaaaagacctgatactagccgggcgcagtggctcacgcctgtaatcccagcactttgggaggccgaggcgggcagatcacctgaggtcgggagtttgagaccggcctggctaacacggcgaaatcccgtctctattaaaaatacaaaaaaattagccgggcgtggtgtcacgtgcctataatcccagatactcaggaggctgaaagaggagaatcacttgaacccagaaggcggaggttgcagtgagccgggatcacgcctctgcactccagcctgggcaacagagtgagactgtctgaaaaa

SEQ ID NO: 77534 - DNA, 802 bp, Homo sapiens
agtgggagtgagagagagagagagagagagaatgagaattccatctggatattatcctggttatataactgtgtataaggcacttcttcatacagtatttaatttaatcttcacaagagccatcctagtgaaatagacgttaatatcactattatagatatgagcagactgaatatcatcaaaatctgactatgcatattaaaaaaaagaactggttctactaagtcctaagaaaaattccgctgttgcctcaaacatcacaactagcactcctagcccagtgtttgacacaaagttgtgttcagtaaagggtgaggtgcaccaaagtcccaaaagataatggacagctgtgtccaggaattcctatctagaggtttcagttcatgttccaattatttcgggggcaagctctttacagaaaaatttagatgatacatcctcttcaatctcattttcgaagacatttgtaggaaaaatgcatttgctgtaaagctttattttaaagaggatgcaaatctaaaaggttaaccatctaatttactattttttttaaatgggattgaaggttaagacatgtatgtaaaacagatttgcttcaaaatcttgagctgctgaactagatgagtaataagttttgaaaagtgaatattagccccttgggcaataataataagatgcacaacattatcgatcttgtatatgcctaataagtaggcatatacaataaactaacatgtgaattgcatatcatttaagagaaaaaaacgacaccacacttttctaaaacagaactctgattcca

SEQ ID NO: 77535 - DNA, 538 bp, Homo sapiens
gtgaaatggaacttttaaaatcttgtaaaagggacccacaaaaaaatctgcaggatacatcatgcattatggtaaaacgttgaaaacattatctttaagattaggaataagacaaggatgcctgctgtcactacttctattcagctttatagtggatgtcctagccagtgcagtaagacaaggaaaagaattaaagggtataagagctagaaagtaataaagcaatatatctgccattattaaatatgaaagggtgtctctttagaaagcctcaaaggattcacagattgattattaaattatttaaaatctaacatgattgctaaatacaaaagtcaacatacaaaattcaacagtatttgtttacagtagagcaattgtttagaaaagcagttcaggaaaaaaaaaattaaaatagcaggctagatgtagtggctcatgcttgtcatcttagcactttgggaggccaggacaggaggattgcttgaggccaggagtttgagaccagccttggcaatatagtgagaccccatctcta

SEQ ID NO: 77536 - DNA, 684 bp, Homo sapiens
ggcagcgttctggttttctggatggcagcagaggacagggagatgatggaagcccggggtgcgggagaaagttgcccgaccttccccaagatggtgcctggtgactccaagtctgaagggaagccaagggcttatctggaggcagagtcccagaagccagactcctcctatgactacttggaagagatggaagcttgtgaggacggaggctgccaagggccgcttaaatcgctgtcccccaagtcctgccgtgctaccaaaggccaggctggcgacggacccaaacccgcagagctgcccccgacccctgggactgagcgcaatcccgagatggagctggagaaggtgcgcatggagttcgagctcacgcggctcaagtacctgcatgagaagaaccagcggcagcggcagcacgaggtggtgatggagcagctgcagcgggagcggcagcacgaggtggtgatggagcagctgcagcaagaggcggcgccccgcctgttttcaggaggcctccagaacttcctgctgccccagaaccagtttgccatgttcctgtactgcttcatcttcattcacatcatctatgtcaccaaggagatggtcttctttctcttcgccaagcactacctattctgcattgcagccattttgctctgtttgattaaaactttctggtcataaatc

SEQ ID NO: 77537 - DNA, 330 bp, Homo sapiens
ttggaaatgggcactattaccctttctttaggtgaagatgatgacttgaggtcacatacaggcagggtcagagcaggactgaacctagatctgcctggcgccaacaatggcatcatcatctccactgtcttctctcccccacagttttcaggaggcctccagaacttcctgctgccccagaaccagtttgccatgttcctgtactgcttcatcttcattcacatcatctatgtcaccaaggagatggtcttctttctcttcgccaagcactacctattctgcattgcagccattttgctctgtttgattaaaactttctggtcataaatc

SEQ ID NO: 77538 - DNA, 722 bp, Homo sapiens
ggcagcgttctggttttctggatggcagcagaggacagggagatgatggaagcccggggtgcgggagaaagttgcccgaccttccccaagatggtgcctggtgactccaagtctgaagggaagccaagggcttatctggaggcagagtcccagaagccagactcctcctatgactacttggaagagatggaagcttgtgaggacggaggctgccaagggccgcttaaatcgctgtcccccaagtcctgccgtgctaccaaaggccaggctggcgacggacccaaacccgcagagctgcccccgacccctgggactgagcgcaatcccgagatggagctggagaaggtgcgcatggagttcgagctcacgcggctcaagtacctgcatgagaagaaccagcggcagcggcagcacgaggtggtgatggagcagctgcagcgggagcggcagcacgaggtggtgatggagcagctgcagcgggagcggcagcacgaggtggtgatggagcagctgcagcaagagcggcgccccgcctgttttcaggaggcctccagaacttcctgctgccccagaaccagtttgccatgttcctgtactgcttcatcttcattcacatcatctatgtcaccaaggagatggtcttctttctcttcgccaagcactacctattctgcattgcagccattttgctctgtttgattaaaactttctggtcataaatc

SEQ ID NO: 77539 - DNA, 153 bp, Homo sapiens
aaagacacaacaactaaaagcaacatatgaacctcatttggatagtgctctgaaaaacattatgtggcagtggataaatctgaatgtgaactatgtattacataatatattaataatacatttcttgagagtgatcattatattgtagtatat

SEQ ID NO: 77540 - DNA, 471 bp, Homo sapiens
attgggaagttttcatgagactgtggaatgtttcctctgcttaggggatttcctggacctttccaagtgcgttccagtctaaaagtctagaacttggattaacctgagggcatttatagcaaactctagctccagatatactcacctggttaattctgccaagctctttaagaaggtagtatcactactagaaagcgcatgggagaccttggggctgacctcggtttgaaattattcaaccatttactatgagactgactttggtggtactttgatttttttcttctgtaaaacaggaataatatttcatagacttttgagaatcaaatactaatgcatgtaagttaatacagtatctgatagcaagtgttctatataaagtagccaattgctttactgagtatctgttttaatgtgtattacataagatattgtgttctcttgtagaaggtaaatggtttttcatcctat

SEQ ID NO: 77541 - DNA, 391 bp, Homo sapiens
gcctctaaccaacaggctatcgtgaagatcatacgcactgcactggttacatggattacagctgcagacttctaacacaaaatccacacacaagtacacggacccaggtggaggcctcagccccttatttcctgcttctctccactgtcttattttcaagctgctactggtgcaccatgagaacctgatttaatactaagtgtccataccaaagcaccattcaactctgtgccacccaccaagaaacaagagagtttttacacaatggctacttgtagaacctccgaactacctacagagtccccgtggtgacatgctgtaaagtactccgtatttgtttccactaactgggtgattgaaaataataaaaatttattatctgacaaatttg

SEQ ID NO: 77542 - DNA, 496 bp, Homo sapiens
gcctctaaccaacaggctatcgtgaagatcatacgcactgcactggttacatggattacagctgcagacttctaacacaaaatccacacacaagtacacggacccaggtggaggcctcagccccttatttcctgcttctctccactgtcttattttcaagctgctactggtgcaccatgagaacctgatttaatactaagtgtccataccaaagttcaatgtctgtccctacagcataatataacatcggttatctcaaacaattgatctggcttagttcctggcccaggtgcatattagtttttggaagaaactgaatacatattgtaaaagtgtattagctctttcaagccaaaggggagtgattaaatagatgacttctccaggggtggaggccttcaagtggggcgagatgaggaggcagagaatcctaagcactctgtttcattttcttgtgagcaaaaaacatgagacagtgtcctttgtttttgattct

SEQ ID NO: 77543 - DNA, 527 bp, Homo sapiens
cttcaggagtggcagaggctcggtccccgcagaggagtctcatcgccgccggtgctctcgcactgtccattcccgcacccatgcattttctcttggttagagaccagaaggatgcagtggccgtctttcccgctgcctttcctttggtacttttgagaactccaaaagaggaccttatttttaactcttatttgtattatcgtgattgcaaatattatgttccagactaaggatgttctttcttattagtttgacttgtatgaaaaccagtccatacatttgatattaagttaatcttttcaattcaaaaaataggcactttgttgattcaatcagattcctccatttattcacttgagcttgtcgtctcttgagttggcgggagtttaatggtttaatccagtagaactatatataatttttcgcctaatttcttcctttttttcctctcctggatattaaaccgcatgcttagtggcaaaaattgaaaaaatagaataaagaataaggaaaaatgatcaatcata

SEQ ID NO: 77544 - DNA, 325 bp, Homo sapiens
atttttaattcatcttataggcatgaggatatatgtattttactgctttaaaataaagccaagtcctcagtgaaagagtatgttaacaatccagatgattgtggcactaacacattaaatagattacacttcttttaaactttctgactttttgctaataaggccagacattaagacagtcacaacttaatgagcttcattccattttttctttcattcccctgagcagccatgtgtcactcgctctgctggtgatggccctgctgctgccttggggctgcacctgctaggggccggggatgggagccactcaagagctcttaga

SEQ ID NO: 77545 - DNA, 798 bp, Homo sapiens
attcaagacccttgtaaacctaaggctatggttattttcagaaaaaaacaaaagttttaatctgtaaagtaagaggaatttggtttcaagcagttctttaaaagcatacagagaaagtcctgaagctttgtatgaaggcacattataagtcaaactgtattttgacatatgctaaaatttacttatctgagcccttaatagtaaatctgacatacttttaaatggagttttcatgaaaattctgggtttggaagagaccccaaaggctcaaaatagctattatttctacttatttaattttgtttttttctttttggccagctgttaaacttaattcattagttcttaagctgtccagagtgcagagcaccaggataagtcaagacaagacactctttgtagaacttcatgaatgttaacatagttaacttaaaattataaaataggtactttatgctaaattagaaatgatcttagattgagtgataagctaagcaagcagtagcaaacaaaattttgaggaaaaaaatttaagtaaaaactacggcaaactttttttttctatgaattgacagaacctcccatttaaaacatatgccagccttggcaacagagcaagaccttgactctacaaaaaatgaaaaaaattagccaggcatggtggtacatgccagtggtccttgctgcttgggatgctgaggtcgggggatcacttgagcccaggaagttgaggctacagtgagccatgattgcaccactgcactccagtctgggcaatagagcaaggcattgtctcaa

SEQ ID NO: 77546 - DNA, 413 bp, Homo sapiens
tgagagcttaaaacaagagttccacagatgaggagaagaaagaagctttcactccaggcaggaggaacagtgtgaggccctgagcaagaaagggtaacaaaccagccaacaaatgggaggtttttcctgagtgcatgatgagaaagaactgccaggaaagctgcagaacagaggtctgaaaacataagagaagccaggaaaatgcaagtccttcctcctgaccctagaaaatctctgctgccaaggctgggactctgctgccaacttcaggcctgggaaaaccaagactccaggagctctacctctaggattcttccaaacatctcaccatgtcctctgatacctctgtagtcatctgccacaacctacttctgaataaatcctacattccacctttctgtgcctgtacccaa

SEQ ID NO: 77547 - DNA, 344 bp, Homo sapiens
tgagagcttaaaacaagagttccacagatgaggagaagaaagaagctttcactccaggcaggaggaacagtgtgaggaactgccaggaaagctgcagaacagaggtctgaaaacataagagaagccaggaaaatgcaagtccttcctcctgaccctagaaaatctctgctgccaaggctgggactctgctgccaacttcaggcctgggaaaaccaagactccaggagctctacctctaggattcttccaaacatctcaccatgtcctctgatacctctgtagtcatctgccacaacctacttctgaataaatcctacattccacctttctgtgcctgtacccaa

SEQ ID NO: 77548 - DNA, 259 bp, Homo sapiens
tagtggagaaataacattgttcaataaatttataaaattatgatggaagaactttttctcccattggaagacaatgaatgtataatctacatccagttaaatttaattaaaatttgttgaaacatggcaaaagatacgtctgtttaaaaacctttttatggccgggcgcggtggctcacgcctgtaatcccagcactttgggaggccgaagcgggcggatcacgaggtcaggagatcgagaccatcccggctaaaacgg

SEQ ID NO: 77549 - DNA, 268 bp, Homo sapiens
ggagctcgcaggactgcaagttgctctggatgggtcagtgagtggtgagtgaatgggaaggcctaggacattactgcacactgctatagactttataaacactgtgcacttaggctacactaaatttacttttttaagcatatttttatttctttaataagttaaccttagcttactgtggcatttttgctttataaacttttaattttttttaactttttgacttttgtaataatacttagcttaaaatacaaacacattgtacagc

SEQ ID NO: 77550 - DNA, 451 bp, Homo sapiens
agtgggttttcatttgcactccagggttcagctgcagacccaccaggtgaagacccaccagcacaccttgccctgcttctgggccacgtctctccagtgcacctgcaggagacctctgtggatgcaccgtgtctcctaacactgtctccagcccacactgagcttgtcttgcgtggaaatctttgtctctgctgttgcctttgcctggagcgtccttgccccacaccctctcacagctgcctctctgtcatctttccaatgtctgtcctcagagagcccttcctggccactccatctaaaggagtcctgggccaggtgtggtggcccacacctgtaatctcagaactttgggagacggaggtgggaagatcacttgaggccaggggttcaagaccaacctgggcaacatactgaaacccccatgcctataacaataaaaaaggaaaaaaag

SEQ ID NO: 77551 - DNA, 281 bp, Homo sapiens
ccctttgaaggtttcaaagcacaggtatcactcagtaagatggattccagtcttcacccttcctgcagtgtgggtatcagtgttgggcacaccagcagtaaggatgctgactaataagtgagattaggactgagaagagaaaaaacaaaggttcccctggggacatgctggctgggagagacctgcagacctggaaggcaggagagtactgggaggagaggaaggacactaggtgtgcagcaggagcaccgaccccaaccgtggagtggcagtggccccag

SEQ ID NO: 77552 - DNA, 560 bp, Homo sapiens
aaacggccccctattactactaattcgcggccgcgtcgaccggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77553 - DNA, 637 bp, Homo sapiens
tgctgtacggaggggacgatgcccagggcatgatggcggcgatgctgtcccacgcctacggccccggcggttgtggggcggctgcggccgccctgaacggggagcaggcggccctgctccggagaaagagcgtcaacaccaccgagtgcgtcccggtgcccagctccgagcacgtcgccgagatcgtcggccgccagggtgagtgcaggggtggggaggtccagctgggcatggccccgggcgtgggtggggagacgagagaaaggagcgtgggacggaaaaggcgaacccggcgaggcccccaagtccaccgcgaaggggtctgggaggagccgagggtcgaccagatgtgaagatgggtcaccttgcgaaaacccacgcttttccgcccgtcttgcctggtaaaaagtgtgaagtttctcgggcgacccagtccggtggtgttcacgttacttgggctgtattcgtggaacaccaggctggcgtggcaccagaaacctcagtgaggtggtaaaaggtcgggctcgaggagttgtgggttcgctgttgggtacggaaagcttcgagattgcaagtttgcgccgccgagtgtcttctaaaagcgttcagcctcccttacaagaacttgttcagatgg

SEQ ID NO: 77554 - DNA, 3243 bp, Homo sapiens
tgctgtacggaggggacgatgcccagggcatgatggcggcgatgctgtcccacgcctacggccccggcggttgtggggcggctgcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccattttgaaccagttaacccattctcgtggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77555 - DNA, 3120 bp, Homo sapiens
agcggatcacaactctgccactgccatcagcaggaacaacccagctttcaccttccactgcttgccatcccaaaggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccattttgaaccagttaacccattctcgtggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77556 - DNA, 4205 bp, Homo sapiens
caggcatgcaccaccacgcccagctaatttttgtgtatttagtaaagacggggtttcaccatgttcaccatgttagtcagcctggtcttgaactcctgacctcaggttatccacctgcctcaccctcccaaagtgctgggattacagcacctagcttctttattttgacaaactaagaatagtatgatatattcatgagaacacatctatgctggcaagctcaagttagggtctttgaaaagtataaccccagagttttattccttggttgtgtacttgacattttaagttacagtttgaagccctctaatcttcacatagttggcactagtaatctgtgattactcaaaaaaaaaaaaaaaagttggttaaagtggagaattacgtaaagttatacatatgtgtcttagatgttttattttaacttaaatatacttaggatttggggtcatggccttttatttgaaattgtgtctgtcaatcagagcagtccttgaataaaaccacacccagcacccacattccatacaatctgcagtatctgtttcttttaaatggagcaggactttacaatgattacaaaatcattctatattacttttttttttattccagccctttacagctgtctcacctattcataattcagtagcagctttttctttaagatactcatcttttttgcattcatgtttcactagtttatgcagtaatttagataatttagttactagcgtgagtacacctaccacaaacaacatgggaataaacaaaactgaatcatagcaggcctagaatttaactggtgggagcagaagtgagatgacctactagccatgagcacggtgtttttgtcatcaattgagttttacagaggaaagagtaatgttaagttaaagtggtaagataattaggtggaagtcagtttaataacttctgtcagataattgtgaaaatcgaggttcttggactagcacaaagaccacagattttaagtcaaactaggttacttctggctctgccacttcctagctatgtgaaagactctaaaacttaacccataaccagatatttagcttaaaaggtgcattctgtgatttgtctttatatatatcattgaagtagatgttgattcttatgaaatgttttctttctaacaggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccattttgaaccagttaacccattctcgtggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77557 - DNA, 3175 bp, Homo sapiens
  misc_feature (152)..(152): n is a, c, g, or t
  misc_feature (161)..(161): n is a, c, g, or t
  misc_feature (166)..(166): n is a, c, g, or t
agcggatcacaactctgccactgccatcagcaggaacaacccagctttcaccttccactgcttgccatcccaaaggttgtaaaattaaagcactgagagccaagacaaacacgtatatcaagactcctgttcgtggtgaagagcccattttnttttggttnttggnttccaacccgttgggggcaaaagggaaaaacgggaaacgaaacttgctttgcccaatgggccccaaaaaagacggagggatccctctcaggcctgcaagaaggccacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccattttgaaccagttaacccattctcgtggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77558 - DNA, 3079 bp, Homo sapiens
  misc_feature (3059)..(3060): n is a, c, g, or t
tgctgtacggaggggacgatgcccagggcatgatggcggcgatgctgtcccacgcctacggccccggcggttgtggggcggctgcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccattttgaaccagttaacccattctcgtggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagctgtttnnctgggggatcctctggaga

SEQ ID NO: 77559 - DNA, 2061 bp, Homo sapiens
atggtgttctagaggatcccgtccactgttcgataatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77560 - DNA, 1866 bp, Homo sapiens
aatctacaagtctcagtgtaaatcataatagagacttacctgttcaaaatggcagaaaaatacttctttactagaaatcacgtaatacagacgcacttacaaaagcaacagctactttccatctttaggaaaactagatttctctaaccttcatctgtagtataggaaaattgaaagcatatggaagaattgtagataacttagcagcaagaatgtaaaatctaattatctgcagagggatataccaatgataaaccaactgattcatcctgcagaatctgagataggcttaggaatcagaaattaggtattatggaagttggagtgtgattgtgagggagagatgatgtgggtggcatcgataaacaccggtgtatcgatgccaccaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77561 - DNA, 2388 bp, Homo sapiens
  misc_feature (2325)..(2325): n is a, c, g, or t
tgctgtacggaggggacgatgcccagggcatgatggcggcgatgctgtcccacgcctacggccccggcggttgtggggcggctgcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccattttgaaccagttaacccattctcgtggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttaancccatttaagggcggagggaggagttcccatttcttgcccttccttttataacttatgactgg

SEQ ID NO: 77562 - DNA, 886 bp, Homo sapiens
gctgatctccagaggatcccccaggaaacagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77563 - DNA, 811 bp, Homo sapiens
gcacaaggaatcatttgtcaacagagtatccgcgctacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttaataaagacttgtttccattaaaaaaaaaagtcgacgccttggt

SEQ ID NO: 77564 - DNA, 553 bp, Homo sapiens
cggccccggcacatggagtggttcagagcggcctgggtgcctggcggacagaacttcagagaccacgcagccttccttcgaagacgcacctgcccagcccagcccaggggtgccgtggaggaccaccctggcggagacattgctgatccctggcttggagctccttggggccgccggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccaggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccactgcca

SEQ ID NO: 77565 - DNA, 455 bp, Homo sapiens
gctgtccttggggctcaaccagtttaccttccattcagccagggatagttgtgcctctcgccacggcctggctaatctgacagctttggaagcatctgacagtaaaagatggtttctcactatggttttaatttgaatttctctaattacgagtgaggacgcatgttttcaaatgcttaagagccatttgttttcatttctcagcgaactatctgtccatattcttattttttattggcttgtaagttatgtgtcagtcactaaagaagttagccctttgtgatgacatggaatatagttcacagcagttcagactgctgtgatccttttgccatgcagaaaaatgttgggtgggcgtggtggctcactcctgtaatcccagcactttgggaggccgaggcgggcggatcacaaggtcaggagatcgagaccatcctgcctaacacggcgaaact

SEQ ID NO: 77566 - DNA, 601 bp, Homo sapiens
cccagtttcctgatgaggagtgcctctgtgacaacatctgtgctgggctcatcttccttgagctcacagtgcccactgaacatcctcctgggactcttcctcaccctgggtttctatactgtctctaccagaggtgcctagctctagtgaagggcactagaggccaaagtatgatgtcctagagccagcacaggccctggggtcatctcttctgccttgtctgcagggcagattatgcccagtccctccacagcagcagagaatgctgggttattggaatgccttcccctctcgttagccttttgcactcaataaatgcttgttttgttggacaacttcagcagcctccttcactggcatgcttgaagagaggttgtcagagcagcagcctccctctctagtttccagggtgttcagtctgagagcccttccatgtctctgttacttgcaattctagtaaggatttgctgtctccccacccagcctcaggatatgggatctccagaggtgcgcaggataggcagagaagaatgacccttaatgtattgcccctgtatctttgccaaggacatttccttttcccaaagtctttttttgctct

SEQ ID NO: 77567 - DNA, 196 bp, Homo sapiens
ttctgatgggagtgaggcctagaaagcaggggcttcatgcagatgcagcagggacactcccaccaagccatcctgggctttggtcatgggtcccacgccaagcacttggacaagtctgttaggaaagggggtggcacatgctcttccgccatctggaaaaatgtggagatccaagggagggcagaaagtgttcttg

SEQ ID NO: 77568 - DNA, 732 bp, Homo sapiens
tgctgggattacaggcataagctaccgtgcctggccaatgctaggcactttttatgggccagggactgatctaagtacttttcatgcacactgcttttcttttctttttttctgagatggagtctcactctgttgcccaggctggagtgcagtggcgcgatctcgactcactgcaacttctgcccacagagttctagcgattctcctgcctcaacctcccgagtagctgggattacaggcgcccgccaccgcacccagctaattttttgtatttttagtggagacggggtttcaccatcttgggcaggctggtcttgaactcctgacctcgtgatccacccgccttggcctcccaaagtgctgggattacaggtgtgagccaccatgacccacctcatgcacgctgcttttctaatttagtgtcttataattgtggagctatgtcttgtgaaaaggtatttccaacaagattctctgagatagttttcccatgtgctttcagtgcctcaggggtggggtagtccataggagcccctgttacccattcaggagtgggtgaggggagaccccagggaccaatgccagcaggaagaggtggggtggttgggaggatggagattgcacatgcttggggacagcttggaggtgcgtgttagaatttttctgagaggggttaaggtgctgttttgtgaagcacaacgagttagtgagtgctaaatctccatgacccct

SEQ ID NO: 77569 - DNA, 119 bp, Homo sapiens
aaaattacctatcaggtactatggtcacagcttaggtgacagaatttttaccccaaacttcagcatcatacaaaatttccatgtaacatacctgcagatgttatgttaaataaataaaa

SEQ ID NO: 77570 - DNA, 837 bp, Homo sapiens
gtgcggccgggttcctaacaggtcatggactggtaccagtctgtggccccagagttggggacccctgccttaatggaacctgcttttcactgaagttgaaaatagatgtggcattctagtttgaaaaaagcagaaatcttgccctttaatccttggagtaaatgtaagtgtcatgagatatttgtcattgtgaaaacctgatccagtggacccagctgtggcatttagtagggtaagcccgtttgtgaaagtcagagagttctaggaagtctttgagacaaaatcttttaaacttgtcagtgatcatccttagtatctgcacatacatactggagctatgtaggctttagtgttgtaacattcaaatgatgtggtttaagtgaaagatcattatacattgtaaaatgtacgtgtatgagactttttttttaatctaatggaatgacattagataaaaaaaaatcaagtgatcaggttaggaattctctagttataccaagtattggtcaactctgtattgccatttgtgtaattaattggtgatgtggatctcctgtaatagtatggctctaagtgttgcaacaattaacagaggccttgtgtatttccacaaatcatcaagtttaattgggagggctttttgaaggtaaacaaagtttttggtgtgtgttgtactttcttttttctggaaactgctccaatatggacagtgggcttagttccaaatagtttagacaagtagactttcacaataaggattggagttacatgcttaaaggagtgttgtaaagaagcttaagatggtccttttatttgcctaatgttaatcagaaagaa

SEQ ID NO: 77571 - DNA, 801 bp, Homo sapiens
  misc_feature (72)..(72): n is a, c, g, or t
aggttctgcggagagagaggctccaagcagtctgggaagtgtagtccagttggcttagcagtagtttcgttnggggggagccgaggttcccggggaaggggctaggtcggcttgaaaagagattatgactgtaccttttaactctgtagctggaacacaagaagtgtttgtttaatgaatgacgtacacatttaagatctgtttggacgctgaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaatatatttttggaaaaatgtgaggcttcccaaa

SEQ ID NO: 77572 - DNA, 1421 bp, Homo sapiens
  misc_feature (5)..(5): n is a, c, g, or t
  misc_feature (10)..(12): n is a, c, g, or t
ggcangaggnnncggccgcccagcagcccgtgggcaggcgcggcggagcgagcggggccggcggcgggcgccgagggacgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgt

SEQ ID NO: 77573 - DNA, 1485 bp, Homo sapiens
  misc_feature (5)..(5): n is a, c, g, or t
  misc_feature (10)..(12): n is a, c, g, or t
ggcangaggnnncggccgcccagcagcccgtgggcaggcgcggcggagcgagcggggccggcggcgggcgccgagggacgccgagggacgccgaggcctcgggcgggggctggcccggggttccagatgttggatgtgatccttaaacaaagcaaagatgtctgccgtcgttgaaagttgtttctaaaaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgt

SEQ ID NO: 77574 - DNA, 487 bp, Homo sapiens
  misc_feature (5)..(5): n is a, c, g, or t
  misc_feature (10)..(12): n is a, c, g, or t
ggcangaggnnncggccgcccagcagcccgtgggcaggcgcggcggagcgagcggggccggcggcgggcgccgagggacgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccaggtgttgtggcacgt

SEQ ID NO: 77575 - DNA, 360 bp, Homo sapiens
ggtgtacccacctccttgaaagcactcatggctacgctatctcattctgtttctcaggtggatgacaactagagtctagactactgtattaaaggactatgaataagttaagggaaggagtaggagttataatccctatgtgcaaggtccttggggtgctgacaggctgaggataacgcctcagactggactcattaccatgaaggtaggaccgtcacctgcacactggagcaacagatgaagacttggcatcaaggcctcttctacaaggatactgctaatattatacactgttaccatataattgcacatatatatctctctcttcccctcaggatttgagaactcctgagaacaagc

SEQ ID NO: 77576 - DNA, 386 bp, Homo sapiens
gaaatgtttgtatggaggacagaaataattcatttcatggagagacaagaggatcactggcagtaaaactgcaggcattatttatgggagactcaaaggagggaatgccccgtgttggcgggcctgcctttcaatccttgtcacaagtcatgatccagaagctcggccaattgaagaaagggtctccatgaagtggagctcatgacctgcctgcatcagcatcactgggggcattttttaaaaatgcagataccagcactgctggggctggggttgggagtctgcaaactcccctgctggttaaaatacaaactgaggtttcagaactattgtgccaaagaatcataactgactccattgggaagtaatgacccatgatttgattt

SEQ ID NO: 77577 - DNA, 348 bp, Homo sapiens
ccctggtgccctccagcccagggctcggcacacagtgggcttcaggaggtcctggtgaaccaggtgccacctgttacagattccacgggtctccagggacctggggccctttggagcaacaccctggggagcgagaagggaataaaggcatctgcccttcctggtttgcaggaaacagcaatgttactgtgcatgcttgggtatttgatttttcctcgaatacctatgtgatatggatcaaatagcaagattctagcagaggaaacagttaagtgtttccaggggagaagctcaaagtcccaggacacggtgtagccccctgggacgggcagcaagtccagggtggac

SEQ ID NO: 77578 - DNA, 338 bp, Homo sapiens
  misc_feature (11)..(11): n is a, c, g, or t
  misc_feature (133)..(133): n is a, c, g, or t
  misc_feature (135)..(135): n is a, c, g, or t
  misc_feature (263)..(263): n is a, c, g, or t
gccaccggccntgtctctggtccagctagcctcacagggagtggcctctaaaactggccggcccactccatttggaagctgtcccgggttttccgtgaagtcctcccggcctgtggtctcctggatggtctgngnaccaacagcttggggatgaggggaggctcgggggcaagggcaggagccccagccaggcgctgggggtgtggctgatcgaagagctgcaccaccccgtagctggccaggtgagtgtgggcgtccaccanggtgcagacacacattcttttccttgacagcctccttaccctggagtttatagccaaacgtgaggtcgatccaat

SEQ ID NO: 77579 - DNA, 361 bp, Homo sapiens
ctttattggccagtggtgcaaagaaatagtaaaaattcaataaaaatattgcttgaaccaggaagcctcctcatagagttgtggactcttcagagaggttttaccaaagtaagggcagaatgtgtataccgtctttcagggattcaagaaatgtaggcaacaatgtctattattagccctcctctccttccatgagcaaaacccaaattacttgtttttaattggcacaaaagcacattcaatcattacattatcagacattgttcatgtacctatcatatgccaggctgtgtgctaagagctggggatctgaagatgaataaaatgtaccctgccacaatcaggattggcaacaactgac

SEQ ID NO: 77580 - DNA, 958 bp, Homo sapiens
aaaactatgcgtgcctttataaaatatggagctgatgttgctgaaaattaaaatgacaaaatattgtgtttagataaataacaacaatggcaatatttttggcaagaaatcacatattgtccctcccccaagcagtctgttccctgcaattctgaatgtttggtaattctaagcaccctagaggaaggtaacattcttcccttggtgtcagtgctaagctctgagattgttatttgtcaaataaagcacaaatgtgttttcctctagttacgtgaagaccttgtgtggaatgccttactgtttggagaaaatcttggtttggctcttgggctctctggtgatcattttataatgctcattatgggaggtgacgggaagaatggccagcaagatgctctagcctgcagaaaagtcactttagcatttccctgctttgactatggcacacggacatttggaaattcttattctggttttggcaacacaaaaagctttcctttttccccttccctcctggctgactaagctcatcttaatgccactaaattaccaatgccttatttggcaagctgcctggtaaatcaaatgaatgacgacaatactggagatcttgtgtggtcactttctaaagggttttgtgcctcctttatactcttgtctccttctccttctttggcgggtccactcagttatttggctctgtttgggaaggctctgggaaaaatgccatttatctatcttttcaacttgaggggacatgctttcttcacagatttctttgggatggaaagttctttctttaacctgattactgtttctaggtgctgtaaattgctgatcattctcagtaaatcaccagcattctgttctttctcagtcttgacaaagttgccattgtgcatatgtgtatttgtgtgtgtgtgacagggaacatgcatggtttctgaaaaaaaaaaaa

SEQ ID NO: 77581 - DNA, 495 bp, Homo sapiens
atacttttctgtataccagggatttcaaatgaatattagaattcctggagagtgactgaagggctcagaaatatttaaaaacccttcaaagcactggttgaccactattcagagcctggtaatcctcatgcccaacaattactctcacaagttccctgttgcactctctgtataccattagcagtagtgtaattgatacaatctttagggaaataagtttggaggtgccttcattttatttttttgaaacagagtctctgtcgcccaggctggagtacagtggtgtgatctcaactcactgcaacctccgtcttctgggttcaagcaattcttctgcctcagcctcccaagtagctgggattacagacatatgccacccgtctctactaaaaatacaaaaattggccgggcgtgatggcaggtgccatagtcccagctattcaagaggctgaggcagaagaatcgcttgagcctgggaggcagaggttgcagtga

SEQ ID NO: 77582 - DNA, 873 bp, Homo sapiens
attttcttctggtgagctgtctaaccctttgtacacattgacatttttaatatcgtaactgatttcttgatgctagtttagctatattaggaaactgcttctacctagattgaaagaaatttgactcataaacttccaagttagaacaaatatttcttcattattgttgcttttatgtgagtagcatttccctatcttgcagttctgttaacatgaaaatggcatttttccataatagctttaaaataattttttagtaattattacaaaattaaggaaaatctctattaccgttatcttttagcattttttttttcctcagtgatctcaagattgtcttagtctcaatgagatgtagctacaaaaatggcacctcttagcagtgatgaggctcaggatatcggatatcataacaccaatgtcaggataaatatctcttctaaagacgatatttaccttttacaaggttagaaaagtctcatactacctcatctttattgtggcgcttttgtagatcactgagaagcttatcttattaaccaatataccacttcctaaatatccatctttggtgaaagaaaatagttgtggtaagagtacccatgattatagttttttatcagaatttgataagattttctgtttctgtgaaacaattattttaaatatttttcttttaaaaataactttttatcagtacagaaaaacctaagggatgactagcttacaaatattctgttaaggggtagttttataaagaaaaatgatatatagttatgttgtcttttatagtgttaaaattagtatttatatgaaagtcaagatctaagtaccttttcatataattcaaactgattgcttgtgatatgtttt

SEQ ID NO: 77583 - DNA, 464 bp, Homo sapiens
acattctgcttgggtgagtaggccactgaccaagtgagcccggatgctgaaattctacaatgtaagtgccaggagggcagcaaaagagggtcatgccatagggtagcgctgtccgatggaaacagtgtgagccatgagtgtaattttaaattttccaattgccacataaaatgtgaaaagaacgccgggcgcggtggctcatgcctgtaatcccagcactttggcaggctgaggcaggtgatcacctgaagtcaggagttcaagaccagcctggccaacatggcaaaaccccgtctctactaaaaatacaaaaattacttgggcttggtggcgggcgtctataatcccagctacttgggaggctgaggcaggagaaatggcttgaacccgggcggggtgggggtggaggttgcggtgagccgagatcatgccacttgactccagcctggacaaaagggcgaaac

SEQ ID NO: 77584 - DNA, 527 bp, Homo sapiens
cacgtttggcttccgaggggagagctggtgccctactcactgcagggaaatttaaactgggtgaaactgaactggtttccaattgcttgtgttctccatttccagccaagttccaggttttcctagagtacagccaggagcatctgcacctagagaacacagaataaaattgtggaaaccaaacttgtaaatgtttttctcattagcttcaggctcccagccaccaataaactgtaggctttaaaaaatcctgtattattttgcaagttaagagaatgtgcatattccccttatttatatgttcaggattttcttaaaatgttacacatcaagcatttatctgctaagccaccccaaaaggtaacagcattctagtttttgtacaaaagagaaaaaaaattccacttaataaacttgcagtaacttgagcctgttggtggtcttggaggaaacccaaatccaggtttggttgatactgtgtaatgtgaatgcaattagtagcggtttttctaaagtagaaagagatg

SEQ ID NO: 77585 - DNA, 390 bp, Homo sapiens
atctcctcccaggtatactcttctggttcttgcttgtacatgttagccaggtcctacagctcctttggtgtctgaatccatttcttaccacagcagtcccagaacttccccagtttgggactgctgaaatttgacccattattgacttgggggaaagatactgtggaaagaaagcattgttttaaagggagcatagagggtatagggaaatctgggatttgagcaagatgtgcaaatgcatatgctaagaagtctacatcctgactcagagttgccacttcctccccactaagtctttcctcctaagactgaaagcaaaacaagggtgcctacatttatcactttcattcaacactgtcctggaggtcacacagcaattgcaataagatg

SEQ ID NO: 77586 - DNA, 770 bp, Homo sapiens
gaggtggaaatggtgggtgtgctgatgtgtttaggttcctaagaaagattggttggtcttccacgttgcttcttggttctctctctgatctccaacttggattcgtgaaacgagagtctgcattgtaaatatgttttccctggccaaggacagatggtaacatttgcctctctttcggcctgctgaatacaaatttgaagccaaacagggacccaaagggaataagggtcccctcaccatcgtgccccttgacacacacccctaattaggatctactcaaatatcatttaccagacactaataaaaatattgagtcctggccaaaaagaaaaataaaaaaaagttgtatgtttgtggaaacttctgtgagtcactctccagcatctaccctgggtcagtgtgttttgctcccagaataagctaaaatttgaatggaagaagaattctaaacaatctaaggaaaaacttaaacagaataacccctgtactctatgacctatgatataagatttgctcctcttaaattattctgagccaagagcaacgtttatagcttaacaccaagcttgttttctgggggtacagttcttatatggactattaagaataaagtgagtttgggctgggcgtggtggctcacgcctgtaatcccagcactttgggaggctgaggtgggtggatcgaggagttcgagaccagcttgggcaacatgatgaaaccccatctctaccaaaaatacaaaaattagccaggtatgatagtgcacacgt

SEQ ID NO: 77587 - DNA, 374 bp, Homo sapiens
gtgaggaagctgaggtggagccccagtctctgcaagggagtgtagcatgttgaaggagggcacatccagtcctcctactgtaaacagctgtgaataaggtgtcaccctgaggcagacggatggctcagctccttaccacatggatggctccttccttccttcttcagggtgcgctggctctccctggaagtttctctgtggaaacaaaaagtggccctggcctggctcaggcttcatcaccattgctccagcctcctccctgcctccagtaggtccctcacatggttccagagggatctttttaagcccggagctgaccccacccttcttgtggctttatgaagaaaagtacaatctgttagcttgtcaaaaaa

SEQ ID NO: 77588 - DNA, 559 bp, Homo sapiens
gagaatgtaggttaaaagaccgaatgaccgcttcaagcactacacatttttcctcctagtgggagagaacagtgtttgtaaataatgatgaatatataggtttttccatttgtgtaccccttttatctgacttcagatttgtagtttgataggtgacctagtctataggattttttttttttttttgagacggagccacctttgtcacccaggctggagtgcagtggtgtgatctcagctcactgcacctctgcctcctgggttcaagcaattctcctgcctcagcctcccgactagctgagattacaggcacacgccaccatgcctaggtaatttttgtattttgagtagaggcaaggttttgccgtgttggccaggctggtcttcaacccctgacctcaggtaatctggcctgccttggcctcccaaagtgttaggattacaggcgtgacacccaagcacagccaagatgttttaaaagagtcatataagagaaattgtaatcctgttttataaagaggacagtgcagggggaaagctgtacccaatccccctgtat

SEQ ID NO: 77589 - DNA, 305 bp, Homo sapiens
tgacctccttctccacatccagccaggggagagtctcagagagccccagcctgctctccgtgctgctgccagaattgttttcctacaacactctcaggaccagggaaacacagaaagctgttttaggggagcatctggcttctgctcctccaactcattctctgcagagcagcaagagtgaagtacctgcgtgtggagaaggaaccggtaacaggtagtattggggaatctgccccgatattcacgtaagttcttttctatttttcctaagcatcggctggcttgagaaataaagggacagagta

SEQ ID NO: 77590 - DNA, 333 bp, Homo sapiens
tcctattgggctaatagagtgtgtgttatgtgtgaaatctttttgaacagtttctttggagattaagttgatttatgaaataatagttagactaagattgatactaaaatatattgttagaaactaactcttcccttagaactgctgtcttttatattgattatgggaaaaggatggtcagtgtacctgactttcaaatatggtaagattcaaaagtaaattgttaattctgctcctcatccccaccatttgtagctctgtgtgtgtgtgtgtgtgtgtgtgtgtgtgtgtgtgtgtgagagagagagagagagagcacacgcacacatgtat

SEQ ID NO: 77591 - DNA, 816 bp, Homo sapiens
ctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggactgtagtcgatacagtcaaagctcttcatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggctattattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatctgagaaaaca

SEQ ID NO: 77592 - DNA, 383 bp, Homo sapiens
tatattaatctcaaaccagaaaaatggagattattaagttgaatttgttagcatttccaagatgaagttgagactgtctttattcatgttcttcgaattaacattaaaaacaaatacatggatagaacgttttctgtgtcatttatttaggcaatgcatcttacagtggtttttgtggtttggtaaataaatacacaaatttattcatggaaaatacagaaaattagtggggcatggtggtgcacacctgtaatcccagctacttgggaggctgaggcaggagaattgcttaaacctgggaggtggaggttgcagtgagccaagatcgtgccactgcactccagcctgcgtgacagagtgagactctgtctcgggaaaaaaaa

SEQ ID NO: 77593 - DNA, 954 bp, Homo sapiens
catttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaaccgggagaaaggccaccgtttgacgcgcgctaaagggaactacatggggggctcctccagattgtggcatgacggttggatcaagcactctcctgaaactggcccggcgtatcacgcaaatctcgacacgcgagagttgtccctcaccgaaagcacgtggaggacgaagcgacaacggggctaggggctcctcaaaacctctcttgatccgcccggagaacgctcccgctacccca

SEQ ID NO: 77594 - DNA, 2336 bp, Homo sapiens
catttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaa

SEQ ID NO: 77595 - DNA, 2355 bp, Homo sapiens
cacaaatatgtatagctcgagtcctggttgtatttcagtactgaggggctgcggttacgctgtaattgactcgcgcccttgcgtgctgcattcgcacgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaa

SEQ ID NO: 77596 - DNA, 2961 bp, Homo sapiens
  misc_feature (2795)..(2795): n is a, c, g, or t
catttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaaaaaaaaaaaccacaaacaaacaacccaccaaaaaaaacacaccacaaaacacaaccaaaaaaacacaaacaaacctttgtgtggccgaccgacattctgccactacagcaaaaaactttttataaaaaaaccccttatctagtggaggggcgggaagaccacaccagtgaggtaaagagcacaacacgtgctgcacaatatgcgtgttacaacagaaaaaaacatctcgtggtgaaaatacaagaccagggggtggaggtacccccacacccaataaaaaaacggagcgcggggggaggacacaacgagggcgcgctttctcacaaacaaaccacaaaaagaggagggtacacggcgaagagccataacaacgaagagggcgcttacactacacagccaaaggacgtgttccaaacaagcagggcagactcgccctatatataaaaaaaacccgccgcnggcgatcggcgtggcagggacgcgagcgacgacagacaacaagaacaaagcagcacaagaaagacaaacggcagagtagcagcaagataccagcacaccacacgaagcacgcagatagatgcacgactcacagcgagcgagaggcaacgaacgacaagcaaacgcc

SEQ ID NO: 77597 - DNA, 1987 bp, Homo sapiens
  misc_feature (13)..(13): n is a, c, g, or t
gacccacgcgtcngcttctgatccccatggtttctgatgagaaatctgctgtttttctcctgtagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaa

SEQ ID NO: 77598 - DNA, 2194 bp, Homo sapiens
cgggagggcggagctggaagggtgggaagcaccgatccaccttattgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaatcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaa

SEQ ID NO: 77599 - DNA, 1951 bp, Homo sapiens
  misc_feature (26)..(26): n is a, c, g, or t
  misc_feature (29)..(29): n is a, c, g, or t
cggcgaattcgtggtgctgctcgctncantcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaa

SEQ ID NO: 77600 - DNA, 1780 bp, Homo sapiens
agaggatccccggtgtatcctttgtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaa

SEQ ID NO: 77601 - DNA, 1462 bp, Homo sapiens
  misc_feature (1415)..(1415): n is a, c, g, or t
  misc_feature (1462)..(1462): n is a, c, g, or t
catttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaatccctgattgattacaaaggaccattagaccnactgactcactttgttttatggctactgccgtgattatgatctgttn

SEQ ID NO: 77602 - DNA, 438 bp, Homo sapiens
caccctccacccctcaactccatactctgttatcttctgggcttaaatgtcacttcctcagggaagctttcgctcatctccctgacagggttgtatactttaatagcaccttacactttcccttcccagaatgtattactgttgtatttaatactttttgtgtgatctgtatttggaaatattgttgtaggctagtatttccatcacagatatgttcttctgcattgttctgcagaggtgggctttagtttatcttgagctgttaagtctgttgtttcaccttatgataaaacaacttggcctcttggctgaattattagcacaatctgtggccaggattagatggaacaaatccagttgttaataatgtaccataaacataactgttggaatttcaggtaacacaggaagaaggacaacagttagcacggcagctta

SEQ ID NO: 77603 - DNA, 2416 bp, Homo sapiens
  misc_feature (2)..(2): n is a, c, g, or t
  misc_feature (476)..(476): n is a, c, g, or t
anagacagaagaaaaaaagcagggggaacgggccggaaatgcgggttcgtgtggggggagcgttcttgggggccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagaatcatttgttgaagaaatacctccactgtgaatagtatagtacctggatgctctagatgatattnaagaagtaaaggaagcagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaa

SEQ ID NO: 77604 - DNA, 1504 bp, Homo sapiens
catttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttat

SEQ ID NO: 77605 - DNA, 754 bp, Homo sapiens
agcagattgggcagccaccaccattgagaggaagaaggacaactgggcagagcagtaaaacatcaagcagatgaccaccaagagtggtgagccagacatggccatattctataggaaaggggaagaagataaggtggataaatcagagaaatgtggggtttcaaagaaagaaccagattcataaggaaaaaagacgaaagaaacaacgttagatgtcctcagaggttcagcagcatttaaggatccaagtctcttggatttggtggtttggatgtgtgtaaccttcttaagtggcaagggcagaaggtagacagagaagtgtagcagagtcagtgggcaattgtggtgggaaggaaggaggtaaaatggttgctccgagaagagccagagtaaaatggagacttgtgttttttagtccgcagggaagtgaactaagtttgtaaacctgaagggtgagatccagccatgaaggaaagatgttgaggagctaatgtaagccacaagccaaatcagagttttgggaccaagagtacaagttgatgagttagcatcgaaggagtgaaaagacactttcatcctgagacaggagagaaataacaaatagacagtggaggagaaacttgaggtccagaggagaggggttgcagtatgtcccctggctgttctgccttctccaccgatgtgtagtgggtgttggagtttcactaaagaagtctccatttcaagaatgcaggttggatgcaacccatttcaa

SEQ ID NO: 77606 - DNA, 4755 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtagggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77607 - DNA, 502 bp, Homo sapiens
cccgctggccccatggcaggatgttaacaactgctgactcataatggttgggggttagccaatactggctttcaacaatttggtatggtccaaattttttcctattaaaaaattggtcttgggttcagaacccaagacccaaaaagttgggggatatatatatatgtttttttcctcgagaaagagtctcactctgtcgcccaggcaggagaatggcatgaactcgggaggcggagcttgcagtgagccaagattgcaccactgcactccagcctgggcgacggagcgagactccttctcaaaaaaaaaaaaaatgacatgggctaaagggacagttggaacagatactgctctaaccttctcaccaacctgtgtgaccttgggtataccacttaacctctctgagcctccatttgctcatctgtaaaatggggatgagaaaagttctgtcttcagtgggttctggtgtggatcaatcaggcataggaagattgtagcctct

SEQ ID NO: 77608 - DNA, 4713 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtagggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggacccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77609 - DNA, 1357 bp, Homo sapiens
caggatcccttggccagtttagtgctctgaggtctggttgccaatgagaatgtgtggtgtgagccttgggccctggatcccctctcatcgactcattatgcacctcacaccaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77610 - DNA, 4410 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtagggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtggtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77611 - DNA, 4273 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtagggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcataacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77612 - DNA, 3861 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtaggcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggactcagcagtgaccacaccaacactgacccttgaaccaataaaggaacaaatgactattaaagcacaaaaaaaaaa

SEQ ID NO: 77613 - DNA, 523 bp, Homo sapiens
cagggaatctgagtgcccgaggggatggagctgctggctttacactgcctggctttcgcttcctacccccaccccatccacccagtgccaacctagttccactgaagcctgaggagcatgccattaagtttgaggtaagtgtaagggataggggcagggacagttggggatctgaaagtaggggccagcctactggctggtcctcatgaccctctctgcagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtaggagcccagctggacctccctgggaaacacgggcagagggcctacaggctgggcctgagttgccacctgcccccaggtctgcgtagatggtgaatgtcatatcctgggtagagtggtgcggccagggccagatggggtcccacagagcacgc

SEQ ID NO: 77614 - DNA, 556 bp, Homo sapiens
cactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggtgtgggggccaggtggggctggggcagagatggagtctcaagatgacataggctaggccaggcgtggtggctcactcctgtaatcccagcactttgggaggccgaggcgggcagatcatgaggtcaggagatcgagaccgtcctggctaacacagtgaaaccccgtctctactaaaaatacaaaaaaatattagccagccatggtggcaggcgcctgtagtcccagctacttgggaggctgaggcaggagaatggcatgaactcgggaggcggagcttgcagtgagccaagattgcaccactgcactccagcctgggcgacggagcgagactccttctcaaaaaaaaa

SEQ ID NO: 77615 - DNA, 4487 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtaggcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77616 - DNA, 1519 bp, Homo sapiens
atagtggaggcatgagaagctaaagccaccccctgtccctacaagctcctcattccctctccccacagcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77617 - DNA, 4201 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtaggcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtggtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 77618 - DNA, 4091 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtaggcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctcgccctgagttagcagctcgcccctgagtacagtaccctgagtacagtacgc

SEQ ID NO: 77619 - DNA, 423 bp, Homo sapiens
gcacccctgagtcacctgtctttcacccacaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgaggtatggcttccctggcagggcacaggtaagagtgggacaggctgggcctggggtggtggtcagcaagtcttgatcacaatttttctcaggtctggggggtgtccttcatatctacaaggagggcattcttgtcagaggggatgccacatgcaaagacttggaggcaggaaagtgcttgaatgcaagtgactccaaatggctggagcgtggggaaggcaag

SEQ ID NO: 77620 - DNA, 1565 bp, Homo sapiens
gtactttgggaggctgaggtgggccgatcatttgaagttaggagtttgagaccagcctgaccaatatggtaaaaccccgtctctactaaaaatacaaaaaaattagcctggcgtggtggcgcatgcctgtagtcccataggctgtagctactgggaggaggcggagcttgcagtgagccgagatcacgccactgctctccagcctgggcgacagagtgagactctgtgtcaaaaacaaacaaacaaacaaaaaaggcaaaattggagctgtccaggccaggacaccccgatgtccaggggcttccatacgaacaggcacatgggctgggaagtacatgaggcccctgggtagaagggtctgtcagttctctcctcccttgccctctgggagggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaa

SEQ ID NO: 77621 - DNA, 2052 bp, Homo sapiens
  misc_feature (1577)..(1577): n is a, c, g, or t
gtactttgggaggctgaggtgggccgatcatttgaagttaggagtttgagaccagcctgaccaatatggtaaaaccccgtctctactaaaaatacaaaaaaattagcctggcgtggtggcgcatgcctgtagtcccataggctgtagctactgggaggaggcggagcttgcagtgagccgagatcacgccactgctctccagcctgggcgacagagtgagactctgtgtcaaaaacaaacaaacaaacaaaaaaggcaaaattggagctgtccaggccaggacaccccgatgtccaggggcttccatacgaacaggcacatgggctgggaagtacatgaggcccctgggtagaagggtctgtcagttctctcctcccttgccctctgggagggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaaaaaaaaaaaaanaaaaaaaaaaaaaaaaaaaaaaaaaaaaaaaaaaaaaagagagagagagaggcgagaagagaaaaaacaaaaaaaaaaaacaaaaaaaacacaaaagagagaggagagagaggcgaggaaacacaaaaagggaggagcagaggagagcgggaggccacaaggcaaagcgagtatcccacgaacagccgaaaacatcatgggcggcacggaaccaaccgctgcgcgccggagcgtaactcgtccccgacaacaaaaaaaaaaagagagccgcgcgcggggaagcaaccaaaccgaagagagcgtggtggaagaaacaccacacaacaagaaggaaggtggactctcggcagcgacatcaaagcaggaggtgccgctctcgctcgccaagcgagggggtgcacacgcgagcagagcgcgaccacatcgagaaacaagcgaccgccgcgccagggagagagaaacgagaaacagcgac

SEQ ID NO: 77622 - DNA, 967 bp, Homo sapiens
cccctgacaactcccttgccccacgcggggtcccctggactcctgccgcacagagcggcttctgcgtcccgatgcgctccagaccccttggtcccagcggcccgaggcttcccatcccggctccctcccacgctcctctcctgtcagcttttcaggggcggggctcgtgcgtctcgcggtcctcccagccctctgcgaatgccgcccctcctgcctttagcgtccgcgctccgccagtgctcctccctctgcttgtgccttccctccgccccaccctcctcgcttctggcgctccaaggcttttctccccgcagccaggcagccagatttttgtttctcttctttattttttctttcttttcttttctcttctcttccttctttcctttctctctctctttttctgagacggagtctcgctctgtcgcccaggctggagtacgatggcgcgatctcggctcaatgcaccttccgcctcccgagttcaagggattctcctgtctcagcctcccgaatacctgggattacaggcgcccgccaccatgcccagctaatttttgtatttttagtagagatggggtttaaccatgttggccaggctggtctcgaactcctgacctcaagtgatctgcccgccccagcctcccagagtgctgggaatacaggcgtgagccactgcgcccggcctcgttttcttatatctctacaaacctaatactgtttttgtctcttaaaaatctacatatgtatggcagagcacggtggctcacgcctgcaatcccatcactttgggaggccaaggcgcgggggggatcacgaggtctggagatcgagaccatcctggctaacccagtgaaaccccgtctctactaaaaaatacaaaaaaattagccgggcgtggtagcgggcgcctgtagtcccagctacttgggaggctgaggcaggagaatgacgtcaactcgggagg

SEQ ID NO: 77623 - DNA, 325 bp, Homo sapiens
ctagatcttgttggaaagaagatgaagatttatgaagggggatagaaggaaatatattgcatttctttttatcctctgcttggtatttttctcttcctctcctgtacttcaacccctataagtctcaactttcatgcatgccacacatggcatatagtatttggaaatgggaaagctgcagtgtgtcttgacctactttccagtgactgtacaattacaaataagaagttgatgctatataaagtagtactacattctacactgaaaagaacatatggagaagcaaagagtgcgtttgcccaagcagcaccaatttttaaaactc

SEQ ID NO: 77624 - DNA, 776 bp, Homo sapiens
ctcatgttcactttttaaaatcggagcttcccagacctcagttttgttttgttattttccattatctgcagctgtctcctttcccctctctcacctatactctactgatcagtgactgctggctcctttgttacccatccttctctttctccacattttttctcttctcatccctttcagttctggactgtttccttcttcctccctgtctttcatttagtcattcattgaatgtacttactaagcacatatagcataatcaggctgtgttgggtaggcatcccgagttctatgagataaagaaagaatgggatatgattaccaattttaagaagcatctaaaacaacctgttatgttttagcaaattgcccccaaaggacccattagggaggaaaacgttcatgtcctttttgcgtatcatctcaagcagtacccatgatggctgggatcccagaacccacctttgagaatgctgccgtatttgcgtgtggttgacaaggttgggccagacactcaggaaatagggttgtcgtcctacctcccccactaacttcctgtaagaacttcagcccctctcaggacctttttctttaccaataaaattcagaaattgggctcaatcagtaattcccaagttattttccaaagaacatgaattttgtggaactttaatagatatcatgcaaaaaaaaatgtgggagggattgttccatggtcaaatggtcttggaaataactcgtttaaacaaaaataaaactgtttctttacccacaaa

SEQ ID NO: 77625 - DNA, 485 bp, Homo sapiens
cagtctcttgcctcagcacctaggtaatcctccgcccacacagatatttgaagccagtgacactgtcctcctaaaatgtctctggatttgccgtcaggatttgctgtaggatgtgttttgtaactcaacctgtgatctgtcctccaaaggacagcctcaggaacgtggggaatctgatcgcctgtatcctacctctgtgtgggcagaggagctgctttttgtgttcagggtgataatgcattttctatttcatttaaattcactctcggccttctttccagattagtagcaggcccagtgtctctcctgggaataccctagtccccttgagttgtcccaagaatcgctagaggtggctcagtcctgtttccccggggaaaggccaaacctctccattctcttggcgagagttaagaaccagccacaattgtaagctgccattgcttctgctgcttccatagggtgttgctgctgacccactgatc

SEQ ID NO: 77626 - DNA, 337 bp, Homo sapiens
aacagactttggagccagtcccatgtgagtttgagtctcagagtgactctgggcaagttacttaggctttctgagactcactttcctcctttataaatcaggaagaataatccattgctcattgagttgttaatgagacataaatgagatagtgtatctaaaatgtgatttgttaagtctaatacgtaatagatgcctatttgagtgtttctgatactcaggatggttcttgggatatattttcccatggaacaaaaagcagactactcatgaccactcggattttatgttcagccacattagggctcttatggcctgacctgaagacctaccattt

SEQ ID NO: 77627 - DNA, 640 bp, Homo sapiens
attagattgggcccatgtggataaaccagggcaatctcctatttttagtaaactgattagcatctttaatttcatctgcaatcttaattcctctttgccatgtatcataagatatatacaggttccaaagattaagatgtagacatctttgggtggccattattctgcctaccacacacaatatgtcctctgactgtaatggaaccaaactggaaatcagtaatagaaatacataccaccacgcctggctaattttatttttgtagagatggggtctcgctgctcaggccagtctggagctcctgggcttatgtgatcctcttgccttggcatcccaaagtggtgggattataggcatgaaccactgcacccggcttaatttacgttttatagtgtgcaattcaatgttttgggtttttttttctttttaaagcatatttacagagttgtgcaaccgtcaccactatctaacttaagaatattttagccaggcatggtaggtagcacgtgcctgtagtccatgctacttgggaggctgaggcaggaggattgctcgagcccgggaggttaaggctgcagtgagctatgatcacacccactgtacgtcagtctgcttgacagagtgagaccttgtttcaaa

SEQ ID NO: 77628 - DNA, 3775 bp, Homo sapiens
atttagactcgttcctttaacccctgggctctgtgtgtatgtgtgtgttttccatatttataactcctgcacatgacaaaggtcctgatacattgtaaggactcagttaatgtttgtggattgcttccttattgatctgttttcacaaaaatgctgccaaaaaatgtcaagcaggataatgatgaggttacaagagagacaagtgaatgggcaagaagagactaagggtaaagtaagaggactaacttccattgactgcttacgaaatgccacgcactgtgctgaggactttatataaatatctcatttaattcttataaaagcccaataaagaaataattatcaccccagtcccaccacctgtttttgcatgattgtggccatgatatcaaaataatcaaatagatggtatttggaggtatataatagtctttacctatgccttccatacatcagggcctcaatggtgcttgactaggatttgcactgtgggttagtatagttcatgggttgttatttgaagctgactcttgtgttcatgcaggagggcaggaatcttcctggctgttctgtctgcccctgttaccctcagtgaaaatgaaaagaagcacagtacatagtggttgacaggaatgaaggtttccaaccttctaactgtggttggagagcttcctgtgtggcatttcccctccttcctggaactctttagtattgtaggaaatgagtgacttgggcaattgcgatagacttcaagcaattggattcactgaagaacattttatggaggaggaggaggaggaacacaaaatcttgaaagctctgggttgagagaaaccatcaagggtatccacgttaaccactaagcaagcttttgaatcccctgatagtattccaaattgccatctctgtgaccttgaacaaaaaacttcacctctcttagtgagtttccacataggcaaaaacaaaaacaaaaatgaaaaaaactaaacaaaaccttctagggttgtcgtgaagatcagagagaacgtactcctggaatatattaggtacccagtacaagttttaaaaatagactttatttttagagcagttttaggttcatagcataactgatcataaggtacagagttgacatataccctgtgattccctggatggcctccccactagaaatatccacccactggagtggtacatttgttacaattgatgaacctatattgacatgcccttatcaccgaaagtccatagattacataagggcttgctcttggtgctgtacattgtctgggtttggacaaatgtataaaaggccattatagtatcatacagaggagtttcactgctgaaaaaatcctctgtgctcctctaattcatccctccttccccaccaacccctggcaaccactgatccttttactgcctccatagttttgccttttccagaatgtcatacagttggagtcacatggagtaaccttttcagattggcttctttcacttagtaatatgcacttaaagttctatgtattttcatggcttgatagctcatctcttttagccctcttttatgccattgtctggatgtaccacagtttacttattcattcacctactgaaggacatcttggttgcttctaagttttggcaactatgaataaagctgctataaacattagcgtgcaggtttttgtgtggatattagatttcaactcatgggtactcagtattttttaaatgaaaaatatatctgtccttactcccataaattcctcctttccatcaattcttcccaaggtgagggatcagtgcatacaagaggcccaatttgcagcaaaatgctcattaattagccaagaggctgcggtggcacagcaagtaaacaacgtactacaaatctgtttacagcggcttctgcagacattttaaaacaattaaactgtcaagggggcctggagacaagagctttgcattttaataggaaatgattaaatctcaggcattattgccttcgatgtgtctaggctttaagaagagggcagagtattgattgaggcctccaggaaggcaggaagcttacttgtgctgcttgaccgcaatgcagtgaaagcttggagatctgtaactccttgggctggaattaaaggccagtagccaaaaatttaactggatttgtcaccttctgtttagttggactctgcctgtaggaacagatgatagatcatgacctccggggtattattcgtcaattggcagagagagagagagagagagagagccccttgctgatggcatctattagaaaaggctgaatgacacagcgccatgtggtgacctcagtatttacactatctggattaaaaccattgtaaagcaagtgaaagccacccatgtagtcactgcctgagtcaactaatgcaaactgcactctaacctgtgaatatgtgtgtgccacagttatgacggacacgcagtctcaaacatctagtgtattcaccttctctattgatttcatctattcacaggtgctggtcagatcacatgtggttcttgccctctagctactcacagtccagtaaatgagggaacatgtaagcagctgggtacaatccaatacagtgatagatgttgttggctacagtgaggggaccaaggaggtcacattcaaattgagagatgtggaggggctggcagaaaattctttctagagaaggttctacttgaaagattagtaggcagacaaggggacaaggacacttcaaactgagggaagttcttgaacaaacctgtggaggtgtgaaaaagcctagtacattccaagaacccagtctggtagtgtggaacctgagtcctctggtactttttaaaggatggggtgaccttagtcctcaggtttaaaaacttaatcaataaatgatgacgttattgaaatatatcaccacataatgctaaatagaacaggtgagcactaccattctctgtgcctttctattgcttaaaatccttccatttgtcatacttcttaaaagtatgccaattggagaacaagacacttgcttccaaaatgagaatacctttgtgaaaattgacaaatttgtgtgaattagcttaatcagattgctttcttccacaacacctgaccaagaccagccactctgatgacgaggagaatagggggatgtggaatgcaaaagaaggtaggagcatggggtactgagggtggagagggctcctcttgcagtggaattacaggcagctagggagcagcacaaaggccctgcatggctgagaattagtttaggggaaaggaaagagaggatagcagaaataaattttacctgacttgcaatttggctccatgtcggctctcatttggtttatttctgtgctgtctagacatcaacagattgagctgctcccatccctggggacccccttccccactacactgaccagtgcagccccctgcagggccattataagaagctatggcacagctgaaagactgagtctcttgattagacctgataagaccactcatattaagatgacttaattttgtcccttgagaaatgcctttttaagagctcccacattggccaagagagactgcctccatattaagctgttcatagttattcactaacaggaggcttttgcataaggctctctgctataaattcctcctgggataatgagaggctcccctatgtgaatcccaggatcactttcttctaccaggtttaccccctgctacatcccatcgacaggtgct

SEQ ID NO: 77629 - DNA, 482 bp, Homo sapiens
aggtggtgtgttgtcctccatttgatatagagattgtggctggtgacgggaactcaaacttgcccccaattcggtgaccttttccccttgattttaactctcaaggtcacacattagataggaagcatggtcccgagattcttgaaatgtagagaaaatacatgaaggacatttggctgtagtctctaaggatgctgcgcagtgctatttgtttgaaaagagacacacacacacacagagaagagtcttatgaatatagagcctgatgactcgtctcttgagtttttcatgtccccccgagtttagaatcccaggctaatagagcctcagcggtttctgaagtcactttctccacagagggcacatgcccaggttctctctgcctgtcccatcttgcctgtgaaaccagagatccagaaagaagtggaatgcatggaacctaaggggagctaactttcaaaaataaatagatgctgattggt

SEQ ID NO: 77630 - DNA, 461 bp, Homo sapiens
taaactcatgcatcccacatacaaatatattcctgatcaagcggcaccaggccctaaaatctcaatccatccttacattgagtcacccacagcagtccatacacgcagagaagcaaggtcctttccatactccatggcacccaagcacagagtacagatggctttgtgtggaggcagtttactatcaaagatatgaggagactttgaagtcaggaaaacattggttctggcccagcaccgctacttccaactcctgacaagttgttttatctcccctagtctctcttttcttattggtagagaagagagtacacctactcaaatggtcattgtgagacttccatgagttaatttggagtttttaagcagtgtctggtacatattaagtgttcaataaaggctactgctatagtcaccatcatcatttaattttttttatcttgacgatcagaaatcttaat

SEQ ID NO: 77631 - DNA, 270 bp, Homo sapiens
ggctacagtaaatcgaggcaagtatgttagtgctagaatttctatatcccttgatgccaggtgcagtgctctgcattgtgaagacacttttctgtgtttgaggccctggagggagaaaggtagctttggccatcatttttcagcgatcagaagccatgcttcagtacagcagcttttaggtaggatcaggcagaggtagtgagatacaaaagctgcaagtgactcgagagctgttctttgatttggaagtgtgtagccctgttctactaa

SEQ ID NO: 77632 - DNA, 693 bp, Homo sapiens
aatttttctaaagataggtgatatagagctcctgtttggatgctctgcagataataaaagatgaaagatttatacaatctgaggagaaagcagagtatgtgcttcaagtaataacgtgtaaagagaacaaaatgatggtatgggaggcagaaagaaaataattgatgagagaggaatttctcaaataggtataaggggaggtaatctagttaacctttagaggggatggcttaaccacaaagaacccagacaaagaggtaagcaaatatatgataacatccttgtaggtatgaatatgtggtggtgggtttgagaaagttttgtttgttctattttctgtgaaacagaaagcaaggtcatcagctgagagtgaggatgagataagaggtactggaggtttgagaagagagaaaaaatgaatacccagtggtccaggacaaggtcggcaaactgggcaacatacatatttttccgtagatatgtggtcacagatcattttttaaagttcactttcaaaatcctcttcttcatgatgtcatctctaaaactgatctgcctgagaatggagatgcaatataggcttttctttcccacctctcctttcactgtctctactccataccccactccttttctgggttctactatggtgccttgtctctggttggtaaaatttcttgaattccaagcaaa

SEQ ID NO: 77633 - DNA, 566 bp, Homo sapiens
cccagccagcagcggtaacccactcccattcccttcaatgttgtaggagctttgttcttttgttcttcgaaagaaatcttgctgctagtctctctttgggtctgtgctgtctttatgagctgtaacactcaccatgaaggtctgcagcttctttcctgaaaccaccgagaccacaaacccaccaggaggaactaacaactccggactcaccgccctttagagctgtaatgctcactgcgagggtctgcggcttcactcctgaagtcggcgagaccacgaacccaccagaaggaaaaaactccggacacgtccgaatatcagaaggaacaaaccccggacacaccatctttaagaactgtaacactcaccgcgagggtcggcagcttcattcttgaagtcagggagaccaagaacccaccaattccagacacactaatataaagtgttaacattaggggaaactgggtgaggggtgaagcttatatgagaactctgtatcagttttgtaccttttttgtaaattgaaaaatattctaaaataaaaaggaaaataatttttcttccca

SEQ ID NO: 77634 - DNA, 290 bp, Homo sapiens
aacttccccagacttcctggcctcaccctctgcctaggcgaaaccccgcaggccaggaacatcccttacgtgagggtgtgcgacagggtagtggctaatccatcctgcttttgtcaaggcactggcaacacagctcaccccagccagaacgaacaccaagtgcacactgggaatatcccccgatctacctaaggagctgtgccccgtggtcagagaccatctacacgtcatcacacacgccaccctgtaccagccgtagtaaatcagccagtttaatcagacgtattatt

SEQ ID NO: 77635 - DNA, 1768 bp, Homo sapiens
ttttgtaaatgggttgtgttggggagagggattaaagggagggaattctacatttctctatgtatgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtataggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaaaaaa

SEQ ID NO: 77636 - DNA, 1836 bp, Homo sapiens
  misc_feature (14)..(14): n is a, c, g, or t
  misc_feature (17)..(17): n is a, c, g, or t
  misc_feature (41)..(41): n is a, c, g, or t
  misc_feature (43)..(43): n is a, c, g, or t
agccaatcttatgnggntatgcaccaagattgaaaacccgntntgatgtttaaaaaaaggcagctgacgcgatccaggattcgcatggttggttgggagagcatagggaggaattctacatttctctatgtatgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtataggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaaaaaa

SEQ ID NO: 77637 - DNA, 324 bp, Homo sapiens
agaccatgtgctttatctacaaggtgctggttggggatatgaagatgaataaaaagaacttagctctcttgtagtaacttctggtatagtgcacaaacatgcttatattactgtaataacagtaatactgtaatagaggaacattccagtggtacctgagtatggagaagtcagcaaaggatttctggaggtgacatttgaactgagccttgaaatatgatgaggatgatgtcaggtgtataagcaagggttgaagctgaaggagtagcaaggaccaggtgttataataaagacctggtaatccaggttaagaaatttagacat

SEQ ID NO: 77638 - DNA, 397 bp, Homo sapiens
gtcacccttcttagacctgtgggccttgcttattttccaaatggtactgacattcaacctcaatatttgctgaatttctcttgcttcctggtactggcgtctcttagccaacaccattccattgctccaggattaggaaaatgttactgtaatacacatttggcttagttaactcataacgataagtgatttaaatgcacacttaacaaagagtctgtgattgaaacaaagacacctaacttctcaggtaaaaaatttatatatatgtgtgtgtgtgtgtgtgtgtgtgtgtgtgtgtgtgtgtgtgtgttcccatacataaatttgacatttagttttttttgtttgttttttggttttttttggctctgtcgcccaggctggagtgcagtggcat

SEQ ID NO: 77639 - DNA, 1122 bp, Homo sapiens
aaattatgcaacatttgagaaacatcttaaaagctaaacatgctagggatccttttcctaatataacatttcatagaaataagaaagaaataataattatttcttttttcttctagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaaatctgattaaaaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctacagagagccatgattaaaccaaggcactccagcctgggtgacagagtgagactgtctcaaaataaaataaaaataacatattggtgaagatgcggggaaaaaaaaagactcttagacacactgctggtgggaatgta

SEQ ID NO: 77640 - DNA, 1134 bp, Homo sapiens
caatgcctgtttcccaagtccaaattataaccccttcacatggatgtttttcctggtttcatgtcctaactacacctatgagattggatcatggattagtttcacagtcatgacacaaacactgccagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaaatctgattaaaaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctacagagagccatgattaaaccaaggcactccagcctgggtgacagagtgagactgtctcaaaataaaataaaaataacatattggtgaagatgcggggaaaaaaaaagactcttagacacactgctggtgggaatgta

SEQ ID NO: 77641 - DNA, 1088 bp, Homo sapiens
caatgcctgtttcccaagtccaaattataaccccttcacatggatgtttttcctggtttcatgtcctaactacacctatgagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaaatctgattaaaaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctacagagagccatgattaaaccaaggcactccagcctgggtgacagagtgagactgtctcaaaataaaataaaaataacatattggtgaagatgcggggaaaaaaaaagactcttagacacactgctggtgggaatgta

SEQ ID NO: 77642 - DNA, 308 bp, Homo sapiens
cccactaagctttgtttgtgaccataaatattacaagtatacactgatttcaagacatgcttggggactgccaagacctccattatgttgctgatgtgtgtgctgtgctagtgcctttcatgttctttcttaaagttaaattagtgctgggtgaagcccatagtgtctcatgagttcagcagtcagtgtgaaccccaaaccattgccgtcagtcaagcagactgggcagtgggatcctagaccagttctcaaaaagggaactccactggtattgcaccattagctgtaggtactcttgattgccatta

SEQ ID NO: 77643 - DNA, 464 bp, Homo sapiens
gctttacattgttctggtatccagtggagcaaatcatcctacttgaagagtcagactccatgccaaatttctatgtgtcatttttcaggcccaaccataggcagttacaaaggccgtacacctcatgaaggaaagctaccctccccatgccagacttggggcacagccaatgcattgcagtctctgaagaaagttgcagtcaaggacccagacccccggcccagccatgctcttaggcatatctgcattcctagtccaagcacctctgtttagaggtctctttattggtggcctcctctaaacaattctgagaccattttactgggatcaggaaccttgatgccacttgtcttcactttcagtatttagtacttttccactcctagcacttttccctctttccccatgattccttgtaacaccatgatgagttacgcgtgtttttgaactttgtgtataccatg

SEQ ID NO: 77644 - DNA, 2869 bp, Homo sapiens
agcggggggcgggaggagccgcgctcctaagcgggagggagatccgccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccaccca

SEQ ID NO: 77645 - DNA, 804 bp, Homo sapiens
ggggtatggaaaacaggctcttaagtataatgtttattgttatgaaagtgtaacttggtactcaatctccatagatgccagtacagcaatatctatttaaaataaaaatccatatattctttgatccaacagttgcacttctaggaatttattctacagaaatatttaaccatgtgtgaaataacatgtgtaaaaatattcgtagaacattgaaattgtaaaagattggaaagatcctaaatgtctgtcaacaagttggaaacaatttaaagtacaagaaaaagagttactggaaaaatacacctatgtacacacaacatatatacatatcttaatgcttataatgaagtatctctggaaaaataagcaagaaactggcctccagaaaagcatccttttatcaagaatgccaaacctgtatcaatattaagagacctgatcacagaagctatggagatcaaagctaaaagacatgaggaacagcaacgagaattggaagaggaagaagaaaattcggtttgtaattatcttcaaaaagttgatttttttcttctgagttatttgtctgtaattctgttaaaatatattaaaagcacttactgttttactatacaagtaagatatgttttttcattgaatctcaaaatatatttggtttgccttatatgtttgctatctttttctgatgtcttaagaattagtgattagtggaatgtaatgttgataggatgaacttccacagtacctagtatctagttgatactaactctgggtttgttaaataaatattgtcttgaatttata

SEQ ID NO: 77646 - DNA, 2939 bp, Homo sapiens
agcggggggcgggaggagccgcgctcctaagcgggagggagatccgccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccacccaaaaaatatagtcgacgcggtcggcgatttagtatagtagtccaccgggaatctcgaccggacctcagcgg

SEQ ID NO: 77647 - DNA, 2250 bp, Homo sapiens
ggggtatggaaaacaggctcttaagtataatgtttattgttatgaaagtgtaacttggtactcaatctccatagatgccagtacagcaatatctatttaaaataaaaatccatatattctttgatccaacagttgcacttctaggaatttattctacagaaatatttaaccatgtgtgaaataacatgtgtaaaaatattcgtagaacattgaaattgtaaaagattggaaagatcctaaatgtctgtcaacaagttggaaacaatttaaagtacaagaaaaagagttactggaaaaatacacctatgtacacacaacatatatacatatcttaatgcttataatgaagtatctctggaaaaataagcaagaaactggcctccagaaaagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccaccca

SEQ ID NO: 77648 - DNA, 1831 bp, Homo sapiens
agcggggggcgggaggagccgcgctcctaagcgggagggagatccgccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttgtaagtacattttaattcttcaatttatgttttctccttctatattttatcatcaaattgagaagcatagttcatatgtatatgaactgtgtgtatgtatatacaattatagaccatatgttaatattcattatacagccatatacatggttagagaaattgtgaaactgtagcttgcttatagaaatgtacttgcagagaaatacttttttatagttaaataaatcatagctcaaatttaaataaatattcaggactccttaaaactaaaatgacaactattttaaaagatgttttcaataatgcaaatatgagatacttctgaca

SEQ ID NO: 77649 - DNA, 1913 bp, Homo sapiens
agcggggggcgggaggagccgcgctcctaagcgggagggagatccgccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttatagagccttactgggcccgtgcagattttccacttcctcggctgtggcccttggcatctgcggttatattcaacaggagcaccaacggtggccaagaagtcactaggatggtggctaaaggggaggagctgagctacaccccacttgatggaacgcaaagactgtggtgaggttggagagcagtgctgtgcgtccttcctcagccttaacgagtgcggggcaaggttaacacagatttctacacccttttgctgcatacacagacgaggccacctgcagatgccaccactgctcagtgaatcagcagaagccttggaaagccttgtgagttccacaggacacagaattgcttgagcttgagccaaattgtctctgttatccattgctacattaaaaaaacacttcaaa

SEQ ID NO: 77650 - DNA, 730 bp, Homo sapiens
agcggggggcgggaggagccgcgctcctaagcgggagggagatccgccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacaggattcttaacagataccactgaaggaagtgctagctgtgatttgagaatggatctaacgcttttccatcttggagctgaattcttacattaccttcttctatatgaagcagatcctctctcatgtgttttctccctcttggtgttttcagtataaatctgaccattttgaaatagttgggtatggacctat

SEQ ID NO: 77651 - DNA, 2539 bp, Homo sapiens
agcggggggcgggaggagccgcgctcctaagcgggagggagatccgccgcggagttacgggaaagttggtccgagttcccagagtttccctctgtggtgccctaggctcggccggccggtgccccggctcctttcctcctttcggccttcgccgtccaccaggtccctctcttctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccaccca

SEQ ID NO: 77652 - DNA, 1859 bp, Homo sapiens
tgtcttttagctttgatctccatagcttctgtgatcaggtctcttaatattgatacaggtttggcattcttgctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccaccca

SEQ ID NO: 77653 - DNA, 866 bp, Homo sapiens
attgatttctctacttcgacttgccctttatggaggtcaaacatcaccagtccttaggtaatacctcggaggccactatctccagacacatcattgtcttgggaaagggtctggggcacctgcatgtctgtgccttggtttccatgtgtccctactggagagaattatgcatagagagcgtggcaggcattgggactaaacaataattgcacccttattccatgtgggggaagggtgggaacttcaggagtgtgctgagggggatttggggaagtggaaacttgacccaatgatgagtattggtgaacctggatccaacaggaaaatgacttgacacctgagccagccacagccccaaatggatcttttccctactcagtgcaatttgacccttattgtccatataagcagagtaaagaagttggggacataaggctgctgctggactgagactctaggctgcatcaaacactgctgaattaaattttaagatgggatagcacatgcatgctccaaataaaaggagatattgctgtgacaaatgcaacacaccatttagaaacatctcttgatttagagtgagtcatcaaaagctttttaatcctgcagtatggagagtcagtggtgctttggtgccctgcctgtttcctgggtatccggcacagccttataccacgagcctctcatatgactgggtactgccttcctaatgagcctggacagtggcttgctcctttagagcacacactggtttgcactgcttcctggaaactacctccctgctaataagccttcccagtaataagcctccctgacaatgcgcctcctgacacatgcttcctcaagtctgtgcctccaaaccccat

SEQ ID NO: 77654 - DNA, 806 bp, Homo sapiens
acgttctctactcatatatgggagctaaacgaattgatcctcatggaggtagtgaatagactggcagttatcagaggctgggaatggtagtggggagtaaaaaggggtgggttaatgggtacaaaaatacagtcagataaaaggaataagcactactttttgatagtacaataggtcaactgtagttaacaataatttattttatatttcaaaatagctagaagagaatatttggattgttcccaacacaaagaaatgataagtgtttggggtaatggatatttcaattacccacaatttaacagttatgcattgtatgcttgtaccaaaaaatcacatgtgccccataaatatgttcaactactatacattcagaaaaattaaaaataaaaagtagatatcttgcattaccatggagtcacatattaaattgagctcatgataaaatgcacaatgaaatggcttgcttggtggtctgaagaaaaatagtcaaagtacagattgtaaggttgaacaatttaaaaaataaatagaggagcaatctgcagaaatttgtagagggtgagacaaaaggaggaatgtaggatgagtccaaagccttcagctgaggtgactgggcagatagtgatggctttaagtgaaataaggacaaatgaaacaagagggttgggcgcgatggctcacccctgtaatcccagcattttgagaggctgaggcaggtggatcacctgaggtcaggaattttgagaccagcctggccaacatggtgaaaccctgtctctactagaaatacaaaaattagctgg

SEQ ID NO: 77655 - DNA, 301 bp, Homo sapiens
cttagagttaatgtgtaaagattgttattaaataagaatcaaaagaagtgatttaaacactaaagaggtagcaaagaaccaaagtaagttgaagaattactgtgttctttaaagacaaaagcagaaatgaatcaactaagaaaaagagagaatgaaaccaaagaacaggttttggaagggggcagacagcgatgaagcggggagagtaaagacaagtagacctggagccggtgtggtggaaaaaggagagaaatcatagcgtgtaagaagtagtaatcgtcgaaggaaggtgaatgcaagc

SEQ ID NO: 77656 - DNA, 807 bp, Homo sapiens
attgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgtggtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattggttggcaatgaaaagtgaagccagcaagagggtgaaaagccatgagaaagcagtcacttgtgttctttacaa

SEQ ID NO: 77657 - DNA, 1412 bp, Homo sapiens
cttagtaacacgttgatgagaaatctactttttccactcttgactcactctgagccttcacagggcagtctgcgaagattgcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaagctccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaa

SEQ ID NO: 77658 - DNA, 1466 bp, Homo sapiens
cttagtaacacgttgatgagaaatctactttttccactcttgactcactctgagccttcacagggcagtctgcgaagattgcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaagctccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctctacattaatacagaggcacaacaattcttccctgaatacaagaactcagaaagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaa

SEQ ID NO: 77659 - DNA, 1560 bp, Homo sapiens
  misc_feature (2)..(4): n is a, c, g, or t
gnnngcatgccccagaggtacagatgtatatgtctcccaggaagtctctgtgggtgaaggactgatctcaagttgtggctgacactagttaaagccaaggtagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttgctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaagctccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaa

SEQ ID NO: 77660 - DNA, 493 bp, Homo sapiens
ctaagactctacttgagctagaaatgttgagcagatccatttctcccctctacatcaaagccaactgtcagtggggaatagaaaaaaaggatgaacttccaggcattttatggactggtgcttaataaaaagagtgcctagtaaagtgcaaatgatagaaacatgaataataaatgtagtccttttacaagctgaccttaattggaaaaagtactcatggggacggatggaagagaaaaaagaaaggcagtgtcttgagtggattttttgacagcagagttccaaagggatgggatgatggaagagcctgttgcaaattttgatagcctctcagctaacattgctcctctaacacatttagccaaaaacagcagcccgtgaatcagtaatgagttaaggtgagctagaactaaatctcccaagggaaaaacagtcctataagtaactggcatactcctttattcacagggcatggcaggaagccaaaagtgaa

SEQ ID NO: 77661 - DNA, 335 bp, Homo sapiens
aggcatgagccactgctcctggcctaaagtgtataaagttttaaagcatgatttagacctgtatacaagtataatctcaactatgaaaatatataacatgtaaacagaaaaatttggaataaaatatccaaatctattttaaatgaaagaagtcttaggagacttcttaaagttatatatttcccatgatctcagcttcccttttctttcctttgaaagtagctgactgccgtatgctaacccgctaggctttattttttcatgcatagtcaccaatcttccaggtttcacatatttttgaatacatgcactgcgacacaggaccagagatgtaa

SEQ ID NO: 77662 - DNA, 210 bp, Homo sapiens
aagtgatcaaatttatgaattattatagcattcctgaaagagaaggagaaaaagcaaataacctgggaaacatatttgaagaataattcaagaaaaatctctctaatcttgctagagatgttgacatcctgatacaagaaatccagagaccatctacaaagtaaacaccaccaaggcagatagtcatgagactgttcaagtccaatgctt

SEQ ID NO: 77663 - DNA, 626 bp, Homo sapiens
ttttaacttacatcttgtttatattttttctaacaacatctagacttaatcattactgtatcttccctctgaacaacatgaaaacttgtgtactttcactaccccattgcctagccttatcatgaacttgaggttcaaagagttaatccctctgttcattattgctttttgcacactccattctattctcttagattttttgctgtaatttttagaacacttcctctaggagtttctaatggttcgttacctacacctttccctcaaccccacccagatgacctaagtcaagatgaaagaaaagatccttctgcaagaaatctctttacctatcaactcatttatttgcccacttgatcttctgtttctccagtctcagagaatccagcatccactgttctgcccagtatttatccattgacctgtgctctgtctggatcctatcttctctcaactcttgaactttttcttttttggtgtttgcatttacttatgctatattaaacctcttggttcctttctcatagccagtaggttcctctctctacttcaactgtttttcaatgccatagattccttctggcaaatattctgtacctcttcttcatgtcttggtaaagcctatt

SEQ ID NO: 77664 - DNA, 417 bp, Homo sapiens
tgacagaaagtgaaaagacaaatgatattttaataatattatgaaaatagtttttaccttgtagaccccctgaaatggtcttcggcatctgtagtggtcccagaccataccttgaaaactactgcattttacgaagaagattgtttcggtaatgactgattaaatcctatcaaggaaatgaaggccaaatgtagttatctttttattttttcatgttccttttaggatgtaaaataaaggttatttgttaacaaaaccgtaaaccaaggaaacatttaaaataggattctgttttacaaaagttgtctagtctctaaagcatttcttctcatagatactaagacttagcattggaccaagatattgtaaaaacatgtacaactataccctgaaggaagagctcttcagtgtctttga

SEQ ID NO: 77665 - DNA, 408 bp, Homo sapiens
ttaagcagtctccatcgcgcaggctggagtgcagtgacgcgatctcggttcactgcaacctctgcctcctgggttcaagtcattcttctgcctcagcctcccgagtagcttagattacaggcatgcgccactacgcatagctaatttttgtatttttagtggagatggggttttgccatattggtcaggctggtctcaaactcctgacctcaggagatccacccggttgggccacccgaagtggtgggattacaggcgtgagccaccatgcctagccttcgatggcttttaatgtctttaaactacagtggttccttggtatcctttgggtagtggttatagtacctctcccctattcctgacacccatggataccaaaatctgcaggtgcttgagtcccttatataa

SEQ ID NO: 77666 - DNA, 361 bp, Homo sapiens
gtgatctgcctgccttggcctcccaaagtgctgagattataggagtgagccaccatgcccagccaactcctaatctttaaaggtgcaaatattttacttatttgaaacagtaacatttttgggagtaaatctggtttattttttagtctcaaaactgaactgcatttcaaccaaagatctattctgaagcaaataagttctcagcacttaaatcaaccaaaaacaatataaaaattcttatctaggccagtagcagtgtttcatgcctgtaatcccaatactttgggagactgaggcaggaggaccacttgaggccaggggttcaagaccagctggccagtctaggtgacaggcaatgtaa

SEQ ID NO: 77667 - DNA, 749 bp, Homo sapiens
cggtaataccaccttccatgcaggccagttttgaagactgaatgagataatgcctgtagaactacttagactggtacaaaataaacacattcacaatgtcaactattgtgcgtgctgtccctgcgtggtgacagtaccacagagagtgttgtccccattgtatctgtccagtgctttgtgagtgtgtgtttgtttttagtggaatgaattcttttcctcattcatgagcatagaggctgatagaaattccaggcaatctgatctacctcgaggtccctcccctgggccctcacacaaagccagaaaacagaaatgagtcctttctccctgtctggcttctggaggctggccatagggcctgaaacggcatccctgccaagctaacacaggttcctgggtgcccaaagtgtgcccgcccctgccagatggcagacagtgcccatagctgccacaccctccaccccagcacactcaggaccatgctcttgttgctactcacccttcagtcaaaaaatcaaacaaaacacaacgggccctggagagctgtcctcaggtttcctccttcccaggaggaagcaaaggtgaaaggaaaaagggtttctgcataaggtgcccacctttggggagtctgaatttctgccctcttattttattaatattatttgctgctatgctgttcagtcgtgaagcccagggccccacacagagtgacgcctctgggtcccgcggtggatggaaagggcggatct

SEQ ID NO: 77668 - DNA, 827 bp, Homo sapiens
cttttacaatggtaaggaatctcagtttggctggagaatagacttcaaatgccagctgaaatccagacggtgattggcctcaaagatggtgaaattaggtttttacatgcttattctcctcttaatgcccaatgagtaactggtttttctcccattttcttattaaaggaaaatgaaaaactgagtaggctgcaaatgatgggattttatttggctctgcaaggatttttataaatactacagcagctgtttacatgttttccatgattgccccatgcatatcagaatgattctgctcattgtttcatgcataagcccacatttgactagtttatctttgaatgtttgccattctcattttgtttgcactcctttgggtaatattagttacctgatgaagggactctcctgtatttggaattccaagctcttccaacttcagaatgccatgtctttactacatatattatgtagtactgttaaacaatcagtttgagatctgtagcacaattcacagagcaacaatctctcctgtatttccaaataaagtctttgaagggaatgatatttgcagaatgtgctatagtggtaaatttagagagtacaagataattacttgtaattatggcaatttctgtaagggaaatcatcttaatttgttcccactaagaaatagaattgctctactcatagcgtgtgaatctttttaggagattaatgcggtgtgccttcattactttgaatggacattacagcttttcactacatctgaaattaccccttaattcatgcttctgtttgaatttctgctaaatgcagtcttcact

SEQ ID NO: 77669 - DNA, 737 bp, Homo sapiens
cgtaatccgcctgccttggccttccaaagtggggattacaggtgtgagccactgtgcccagccctttctcactgacttataagagtactctctgtgtgctgcttctgcttgctggttacccgcccactcctctgtctttgccactctgttaaagcggcccttgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttccctttcctactaaggggggcaacttaagggaactccaaatgtttcgggggttcccacattccattctggcaacttaatccacatccttc

SEQ ID NO: 77670 - DNA, 6229 bp, Homo sapiens
gcccatgagcgcgccgcggcccgggctggcgtgcgggtgcggctgcggcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacttcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccccctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgcgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacattaaaaaaaattgaaatag

SEQ ID NO: 77671 - DNA, 4222 bp, Homo sapiens
gcccatgagcgcgccgcggcccgggctggcgtgcgggtgcggctgcggcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacttcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccccctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgcgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatctta

SEQ ID NO: 77672 - DNA, 6352 bp, Homo sapiens
gcccatgagcgcgccgcggcccgggctggcgtgcgggtgcggctgcggcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggagggatgaggtctcactccatcacccaggctggagtacagtggcaccgtcatagctcaatgcatcctcaaacacctaggctcaagtgatccttttgccttagcctgccaagagctgggactacaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacttcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccccctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgcgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacattaaaaaaaattgaaatag

SEQ ID NO: 77673 - DNA, 1471 bp, Homo sapiens
cgtaatccgcctgccttggccttccaaagtggggattacaggtgtgagccactgtgcccagccctttctcactgacttataagagtactctctgtgtgctgcttctgcttgctggttacccgcccactcctctgtctttgccactctgttaaagcggcccttgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacattaaaaaaaattgaaatag

SEQ ID NO: 77674 - DNA, 1034 bp, Homo sapiens
gcgttatttttcttacccagtgtctgtatattatatagtatacttataatacaataagctagcaaaaagaaaatgtcactaaaaaaatcacaaagaagaaaaagtatactcttcattaagtggaggtggatcatcataaaggtcttttcccttttcatctttacatttagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacattaaaaaaaattgaaatag

SEQ ID NO: 77675 - DNA, 400 bp, Homo sapiens
gactctccctatctcgagtgcctctgcctgatgaaggaaaggaagtggctaccagagcaacgaatgatgaaagggtatgtatgggacacacagggctttgtgccttctctggaacaaccggtaaatactacgcaaatgccttcatgagattttggtgaattttctaacacaatttaataataaatgagtgttaaggaattttgtaatatgggcctcaaaattggggcaaatgtatagctaatgtcttaatagataatttcaggttcgaatgctgattttttgtttgtttgtttctcagtgttcttttttaccttctcctggccttttggagcagtcttgattttgatggccttaaagtgagaagaaatctacaaaaatacaggagcatacaggggaaaag

SEQ ID NO: 77676 - DNA, 481 bp, Homo sapiens
cggttccgcacagactctggctgctatgccaccacaggcctgaagatgaagcacctccttactgggcaagagaggaccgtctggcacctccaatacacagactggcctgaacatggctgtccagaagacctcaagggatttttatgtgagtgactttaactttgttccgaggacagctgcctctggaggtgttaaacagagaggaacatttatgtttccgaaatatttcctttatgttatctcatataagcttcggacttgttttaacataaagaatacaagtgttttggggagggttaacgaggtttataaattatgatttggtagtgagtagaatgccacagctgactcagtatctccgtcatttcattttgtagatcagaaagtggacagaggtagtgacttgctcagggtcacactgtccctttgtggttgggtttggttcactggcacccagtgctctttatctgcagtcctctta

SEQ ID NO: 77677 - DNA, 5541 bp, Homo sapiens
gcccatgagcgcgccgcggcccgggctggcgtgcgggtgcggctgcggcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacttcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccccctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgcgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggtaggtacttatttctcttaagtgattttctcagcctctgaagaacagttaatgttaatcatctggaatccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacattaaaaaaaattgaaatag

SEQ ID NO: 77678 - DNA, 464 bp, Homo sapiens
tctttttgtgtgggactgacacaaccctcttaaccttaccacatctggaaacttgcttgaactgctgaatctcagaccctatctcagacctaagagtcataattgctcttaatcaaggttgtcaggtgattcttatgtacattaagtttgcaaaatgcagctctattgaaatacagaggaccagaaattgtataattgagaataaggtgaggagaggaaggggtgcatgtgtgtatgtgtgagagactgggaggatgcatttcacttgtgtatgtaattgtgggagtgtgttctcattttacttgaaaaagcagctcactgagctataattcacataccatgcagttcacctattgaaagtgtactgtttaaaccacttattggttttaagtgtgttcacagccttgtgcacccataaccgcaatcaattttggaacgtttttacacctggaaagaaaccccat

SEQ ID NO: 77679 - DNA, 381 bp, Homo sapiens
agccaatatgctccttcaacaattttcttagaaatctctttagctatgtattctatttcactgctcccaaattctacattctgtaaaacactggaacataaacacaatttagccaaggtcttttctactttataacaaggatacccttttctcaaatttccaacaatgtgttccccatttccatctggaagttcactagaatggcatttactgtccatatttttatcaacgttctgttccatgttacttagatatgctttttttttttttttttggagacggagtttcacccttgttgcccaggttagagtgcaatggagcagtctgatctgggctcactgcaacttccgcctcccgggttcaagtgattcgcctgcctca

SEQ ID NO: 77680 - DNA, 840 bp, Homo sapiens
gcctgaagcctgaggccaagctgaaggccaagcctgctggggggcacagagccagacaggacacagtgggctcgccaacactgcagaggaaaggggttctctctctgggcccaacagcactggtcccgcaagcctcaggccccctaagggctggtcggtgctgcacagagagagtgtctccaccccaggccatggtacgtgcccggttcactgtcccaccacgtgcctccatccagctacgttggtcaggtctaggatgtgccactcggctctcggggacctcagctgagcgaccgcattgcccaggatgctggaaatcctcacgataggccccaggccggagggctgggtgggggtatggctggccccctggcacaccagtccccagtgctggaaaagagctcaaagcccatgccctggggccttcaccctgcaggcctatcacatccactctcccagcgccctggctgtaggctctccctctcttccaaacgggagggccgtcctgcaggcccgtacacaggcgcttcatatccacagctggaaactaggtcgctgctggtgagaggcagcaggggacggtccacaggctttcgcagcacccttcctctgccactggttccctgggtcactgtgcaaaagcagaggctgcaaagtctgtggtggaacccgggaagccggagaaggaacacgggggcctttgaggcttcttcccgctgcccgattcctttcaggctcggcctgatttctctttgagacttgggctggttctgcccctcacacttccttgctggtctggacatttttcagcctcatctgtcctcttcttctcttcccaca

SEQ ID NO: 77681 - DNA, 387 bp, Homo sapiens
tgagaggaaaatatcccttttctaaaaaaataaaaaattaaaaataaaaacctcggtgtaaagtggaattctctagagaatgcattgtgcacaaaatgaccttcctcagtgtattactgggatggagggagtcgtctctctgtggggtagcaaataagccctgtggccccctcaatccacctcagcctccacagagcatcagttgctgtttcatcccgggttggtccagacagccactgccagtccactagagggagcacttgagaggaaacccatttgctttcattgatctagatctcaaataaaatttcatcttagaggctgggcgcggtggctcatgcctgtaatcttagcacgtcgggaggccaaggtgggtggagcacgagg

SEQ ID NO: 77682 - DNA, 123 bp, Homo sapiens
ggccttctaacgttggtggaagtggctttggcttattgggtcggattctaggccattcattccaacctttagagacatcccagctttccctagcccagagtctgcagcccctccaccatccca

SEQ ID NO: 77683 - DNA, 689 bp, Homo sapiens
ggcagggaatgatttactgtggaagttctcataccaacagttatgtttactccaacttataaccgcacatctgcaggtgactaaaattgtgcaagcggaaagtgagttcaaacactgacatgcatacctgtttgaatcagtgatttgaaccctaggaatacattagtgtatacaaatatggaaaccacagggaaaaaaaaagcatttctagttattactatgataatgaagaatgagaaaaacaagaaaaacaggaaaataagaagtcataaaatgctaagtattctgtgatgaatgtactttttcattcaggtaaactcatttttttatttaggtaaaatacaaataaatacctaaattttatttaggtaaccctctctgttaaaaaacaaatggatcaaatgctatccaaattacctaaagtgggaggcgggggtatgattaaataatataaacatatttaaaaactattttcaaaaggatgtaatataggtagacaaagtatccagaaagatacaatgggcacaacctaaaaatatttaagtctaaggatggaggtaatctgggcactgggaaatcaattaagtatatatagaaatgattcaaatgccttccctcagcaagaatttgcctattctatgtctaccacagttggacactagattagtttggatctacagcaagaaata

SEQ ID NO: 77684 - DNA, 655 bp, Homo sapiens
cagaaaggctggggctgcctgggccaggcctccctgcgctgcccgggctatgcacaggactgggaggatcccccaagctccctgtgtccaaggggctcaggaggaagcctggggcaaagagaccattgccatacctgatcttggggaggtgggacgaggtgggggagaagggagaagccccaccctgtcctgccctgcccactgcaggctgaggcgtctcccgaggccctcacccacctgcactgtggcgggtcccctgtggctcacctgtacagcggcccttcctcgggcagcaagctccccacccacactggctgtgctggttcctgggctgatggggataaggaggctgtgagcaaaggggcaggtggctctggggaggcctggggcgagaatgcagggaggctcagaagtggtgggcgtccttgctgggccagggagccggtctgaggcagggactgtcccctcctatcctgcggcccagacccggccccaccccccaccgcagcccttgcttatcttcaggagtcctggtgttgtccctaatggccaccaaggcccgcccaactccactgcctcctcgaagcagtgcaacttgaggtgttggggtctccccaccgtggccaggcaccctaagtctggacagagaccccag

SEQ ID NO: 77685 - DNA, 260 bp, Homo sapiens
gaggtgcattatgtatatattttaatttttttcatagatgatggtgtccagtatataatttgagaccaggtgcagtgtctaatgcctgtaatccaacaatttggaggctgaggcgggatcgcttgaagccagagtttgagaccagcctgagcagtgtagtgagacctcgtctctacaaaaatttaaaattaattagccaagtgtggtggtgcacacctgtagccccaggtagtcatcaggctgaggcaggaggatcactt

SEQ ID NO: 77686 - DNA, 364 bp, Homo sapiens
ctgggattacaggcgtaagccaccgagcccagcctgtatttttagtagagaccgggtttcaccatcttggccaggttattcttcaactcctgaactcatgatccatccacctcggcctctcaaagtgctgggattacagacgtgagccactgcgcccggcctacaatatctattataatgcacttctctctttttttttttttttttaacactaagaagatatttcaggctgggtgtggtggctcccatctgtaacatctgcaatcctagcattttgggaggctgacacttaagcctcggagttcaagaccagcctgggcaacatagtgagaccctctcctctataaaacaataaaataaaaca

SEQ ID NO: 77687 - DNA, 442 bp, Homo sapiens
catttttaataacaaagagaatgctaaatgaacttggttgggggggcggggaagaaaaacacatcgtactgtatacaaagaactgccttaatcatggcagatttttgcctttggttcacatgttgctgaccaaaggctacaattctgttctgaatgtgcactcctaatttatttgatttaatttattcaatttattaacttagttttcttagaccaggctgaatacctaatatgtggctttttggctgaggctttttacttctgtttagaaatttgatgcctattttaggaaccagaaaaagataaattgcttcagtagaagagaccatatttaactttaaaaagtgaggaggaatgtgctttttaattatgctctcataagtctaatcttttgggggtttagtagcacatagataaatattaaaggtggttacatataata

SEQ ID NO: 77688 - DNA, 2875 bp, Homo sapiens
cggaaagcccttaggtggagagcgatgtggggcgcggcagggggatcgcgtagaggaaccttcgcgcaccgcctctccgggtctgggaatctgctgaactccttgcctctcctggggtccctcgaacgccccagctaagaagggcgggggccttgccagggcgcgagcaacatgacgttcaaggtcttcctgtggcttctgtaaagaaatgttcacgtgggagcctgtccacatgggctgtactaaggatctggcacgaggaagaaatatcactgcagaacctgaagccctccgttggaagggtcgttcactcgagtacctattctaagtaacagtgacacaaaacacatgttagaaaaaaacaaaaagtatggtaggttatactgttttttaaaagaaacttttatttatgccttttgctgttaagtcctctaattttacattggaactgagtcattcttggagcaaaactagaataggtttgtatttgttttctttttggatgtgtatctaaattgtacataattaagaaaaagcaagtaatggaaaagctggagatgtagaacttagttccttctaacttagtatgcaattgaaagcctcaagtcaagactcctgtgtattgttttgtattaggactctattgtacaaatatttgagtaccttaatatgagtcagttactttttctagatcttggatccatgccagacaacgcacattctgcagacactggttactccagtggctccttactggaaacatataatatcagtgataagtgctgtgaagaaaataaaacaatgatgtgctggtatggatttttaacttttttatgtgatgaaccacagaatgatggttttaaatgtatgaaatacatagaattgcaacagaaaccagttatgaaataatgaagatattaaatatgacatctatattttagtaaagcattagtgaggactgtaaatgatctttaaagaatttggcttaaatttaatctaaaattgctatcaggtatttcacatcgctgtaatttttgcctgcattcgtaactgaagagataagtaaatgtcagaggttaagataaatctttttctttttttacctgtccatatttacaaacattctgcgttccgtacatagacgcctggataagaacccctgtgcaagaatgactttggtgctactttaaaaaaagtggttggggaagacctcataggaaatgacatcaataatagattgcatgataacctatactagttcttactgttaccaatttaaattctaactgcttaaaagctaacacggtccttccctttttttgagcacctgatttgaagtactttgagtaggcctcaagtgtcgtatgcaagtactaatctagggggtgtgcctttttcaaaagtgatttttggagaagataggatgtagtattatagcaaggaaaattcagcatctgggatgatcatttccttctgattagagaaatttaccttgttaatattctgttcacccaacccttctaccctcagtgttgaccaatactggaaaaaatttagggctttggagtgaaattttaaaagttcaaaaccttgatctattaattagtttgcttaccttgaggaagttgcttatcttaatcttctatttgaacttcaagtacaaaaaccctactcacggacttaactgtgaccattaaatgagataaccaaaaggctgaagatgatagtgagttgattttaccttttttctacatacagatgtttcagttctttcattagtggttgaaggtctgcgttctttttctccctccactccctccttgactacccccagaatgagctttgatggtctctactgggcctttgggggggatacattatcctgttgtttttgttctgttacttatatataatactcatggatttatttctacttctcttccattttctaatttataataacatgtgcatcttgttttccctgccaaactaaatttcgtgagggggtacatactgcacagttttttttgtcacatactgcttatgacacatgaatatgcagagcttgtcaagctctttaattaagtttaaaatgctaattgagtgaatcaaaacttaaccattatggttaggctaaaaatgtcagcttgtgtttatatagtgcttacctcagtattggaaatgccatgagtttagtatcagaaggacattattactagtgcattttaaagtgataccagtcatagttgcaaaagaaagtacacaatgggaaatggaagagaaatgtagggaatcaaaacaactagttttttcctttataacggaagttttataattcatcttttatgtaagtgtaattctcattaaaaataccctaaagcttaaagtttgcaaggctgcccagcctaacccacaacagtttgatgctgccccctagcgtttgattcccttcaccttttgctaaaataaggtaatgtttaaattacaattagatttacttactgctgtaaatctggtctattttagtttcctctgggtagttagtgttgctaataagatggacgtaagtgtttttgaactggtgaattctgattgcttttagcccccagttttccaaataggggtgaattttgggtagagatagaacaatcaccaagttaccttgctccaaaaaagaaatttacgtatgggattgttttcaaagcgggaagttagctgtgtaaataacaacaattttatatatttaatctgggcttctccttatcttgaatgatataaaaatctactttctagattaatttagttccatataactttgtattgctttgactgtactgataataaagtttgaaagtgttaaatttaaaaaaaaagc

SEQ ID NO: 77689 - DNA, 597 bp, Homo sapiens
ggcacgagcataccccatttgtgagctttctttgagggccaactttgttctctaaaaccagccagggcatgcttttccctcaccagctctgaattcttccaggctaggcaactggaaaagcctgggcttagaaactgctttgttggcttacggcccagctgagctgaccaaaatagccaagagaaagactgtttgcacagtgtgaaattcctccaggggaaataccatagcaaaaagccaagaaagccagacccacgatggcaggaacccacaggcaaaaaaagccgagttacccccaaggcctgggttgtggagatgggagcctagttctctccagaagaaaaagcttcctaaagcctactgttgtggtatttctgtaggcgcgttttcatcatcctgctgggtctcaagagtagcattctcagtgaaaggaacagtcgaacagcctgcagcctggtggccagggctcagaggtctctcttcctgttacgtgctctccccaagtcaggcctagaaagaccgtgggacagggacacactcccagctctgtgttgatgggacagtgccgaagggtgcctggagtatgcactggcaggt

SEQ ID NO: 77690 - DNA, 296 bp, Homo sapiens
gcgcgaattcatcatcctgctgcgcgaattcatcatcctgctaattcatcatcctgccgcgcgaattcatcatcctgctgcgcgttttcatcatcctgctgggtctcaagagtagcattctcagtgaaaggaacagtcgaacagcctgcagcctggtggccagggctcagaggtctctcttcctgttacgtgctctccccaagtcaggcctagaaagaccgtgggacagggacacactcccagctctgtgttgatgggacagtgccgaagggtgcctggagtatgcactggcaggt

SEQ ID NO: 77691 - DNA, 565 bp, Homo sapiens
cttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttg

SEQ ID NO: 77692 - DNA, 382 bp, Homo sapiens
gtttcactcttgttgcccaggctagaatgcagtggcgatcttggctcactgtaacctctgcctcccgggttcaagtgattctcctgcctcagcctccctagtagctgggactataggtgcatgctgccacacccagctaatttttttgtatttttagtagagacagggtttcgacatattggccaggctggtcttgaactcctgatctcaagtgatctgcccacctaggtctcccaaagtgctgggattgctggcctgagccaccgcaccctgcctagaacatgctttttaatagtgtctctaaccatcatgtttagggccttagtgcttacctcttaaagaagggctgctgttgaggattccttgagatagtgtttgaaaa

SEQ ID NO: 77693 - DNA, 275 bp, Homo sapiens
ggtaggacccgacaccgcggtcgtacccgccttcttttctgtcccagagtacagcctgggatctccaggggggagactgaatgagtgctgtcgaggaccggcgagagtctggaacgttcgcgccttcgtaggagaacgaggaggtgacggacagggaacggggagcggccgttgggtgggacgcctgagaccctcgggaaatggccgggtcgccgactgtttgcaccactggcatcctgcagcactgtgagatacggccccgtttgttcccagaa

SEQ ID NO: 77694 - DNA, 131 bp, Homo sapiens
cgaacaggcactgaggcctggggagctgtcacaaacggctgcctgatgggggagggttaccgtaattgccggattaacttgggggactttaaactgcattcctctttaaaatataaagtataattgttgat

SEQ ID NO: 77695 - DNA, 387 bp, Homo sapiens
attttgaatcatattttacttataggtttgctgtatatactgattaaacttctgaacctaaagattctctataattaaactagcacaaatataatctgtcccttacccacattgtaagaatgtctggtgggggaaatccaatattgaccttcacattccacatggaaaatctttgtccccagagtgcaattagggtgattaaaaataagccgcttttgtgagtctcaagtttgttccccaaacaagcagcatcagcaactggaaatttgttagacatgcaaattatccagtcccacctgagacttcagcccagatctatgaatcaaaaattttggagtgaccctggcaatatggactttaataagcccctaggatggttctgatgca

SEQ ID NO: 77696 - DNA, 360 bp, Homo sapiens
tcatggattagtcgttcttttcctgccttcctctctagccttgctgctcaagagccatagactaagaatgagaagggctgttaaagacacctctagtgcagccttttaaatttaccgataagaaatcagaggcctgaagagaagtgagttgcctgaaagcccacagcaagtcagtgacaggccaagaccagatccaggctgcctgactccagtttcttcctcgggcccccatgacctttccaggcgccatgtatgtttctccctggtctcagggtgagggtagaagataacctttctgaaagaggccacgtccctggcctcccagtgaagcactaggtgaagccaggccaaaaagaaagc

SEQ ID NO: 77697 - DNA, 502 bp, Homo sapiens
gaggaagaagggcagctgggagatgaagctgtcaggatgggccgcatcccatttcctgcctcgtttcagttcaactttccaacagacctccctggctcgtcttgctcttctctaatggacaaacaaacaggctcagagaggtggtgtgacttgcccaaggtcactcagcttggatgctatggaacagggacgtccactgtcccagtctgtttatgggaagccgctctgcaactgtcctgacccaccacatgccccaccgctgtttctcttgccctgaccccttgttccctggaccagggtggcacagctccaggctcttgggcccttcccgagggcaggcacctgtgactgtgtccccaaagacctgagtggctgagggggccccacagagcttggacttcctggaggacaaggaggggtctgccagccacccccaccacgcccgccccagggctcccctggagcttccatgccagccggactcaggtgggtctggaggagc

SEQ ID NO: 77698 - DNA, 475 bp, Homo sapiens
gtttagaagtaggaaaatccacttcagttttaaagacactgattgttttagtgtattggagcttctatcacaaaaaaacagtgtagcctgggtggcttataagcaatagaaatgtatttctcacagttccagaagccacaaagtgcaagatcaaggcgctggcagatttggtgtctggtgagggcccactccctggctcatagatggctgtcttttcattgtgtccttgcatggtggcagggatgcgggagcactctccggggcctctcatagaagggcctggattccattcatgagggcttcactcccatgacccaatcacctcccaaaggccatgcctcctaattccatccccttaggggttaggattttgacatgtgagttttggtaggggacacaggcattcactctatagcactgataaacattctttgataatagccattattttagtgggtaaggtgtttttaaatac

SEQ ID NO: 77699 - DNA, 3342 bp, Homo sapiens
  misc_feature (226)..(226): n is a, c, g, or t
  misc_feature (494)..(494): n is a, c, g, or t
  misc_feature (690)..(691): n is a, c, g, or t
  misc_feature (925)..(926): n is a, c, g, or t
  misc_feature (934)..(934): n is a, c, g, or t
  misc_feature (1174)..(1177): n is a, c, g, or t
  misc_feature (1927)..(1927): n is a, c, g, or t
  misc_feature (2163)..(2164): n is a, c, g, or t
  misc_feature (2424)..(2424): n is a, c, g, or t
  misc_feature (2443)..(2443): n is a, c, g, or t
  misc_feature (2664)..(2664): n is a, c, g, or t
  misc_feature (2694)..(2694): n is a, c, g, or t
  misc_feature (2700)..(2701): n is a, c, g, or t
  misc_feature (3084)..(3084): n is a, c, g, or t
  misc_feature (3311)..(3311): n is a, c, g, or t
ctataatcccagctagaaaaaaagaaatacgttggtcaatatgagaggttgagttttacagttgaaggggaagggtgcagcgatattaattggctgtttctgacagtagtttggcacatagttgtatgtacactctgctccagtaaaatgaaatgcgaccacagtcaacggttacctatttatgctggagggtgtttggcaatcaactgttaatttaagtgagatnccattctgccgcttagccatggcagagcacacacatgtgcactcagggaaagcagatggaataggttataaacagaagcaaactccaattcaggagacatgttcacgcagaaatagtactatgatgcaacatacatcacaaaaacaaatggaaattgtgtttgtttgtttttgagatacagtcttgctctttcgccaggccagagtgcagtggcacaatctcagctcactgcaacatccatctcccaggttcaagcgattctcctgcngggccgcccagcccgcgtcacccggcagcaaacacgcagggtgagtgtgcgggctgcccaggcagtgcagagcggagagagctgcgtggggccacactcactcgcactcacaccgggggggcacgccggcctgggaccccgtgtgcgcactccctggggacaagcggggagccagcaggacagggacccgcagaanncatactcacacgttcctgcaggtgccagcacatgctggcttcgttcgctctcacgggacacacgcaggtgtgcaaggacaatgcaagtgcacgcacacgtgtgcagacacgtagtggaagcatccactggctcacacctgtaggacacacacacacacacaaacatgcacacatacagagttggttgaggatctgttaacaccgtacaccccctaatgcatgctcgcgcgcaannacgcacgngcgcacacacacacacgcacacacacacacacacacgtgatcaagggcacccagggcagaatcttccatacccctaacaaggacccctaacaagacgcacaaacacgcacccatagaagtaatcaggggaccctaccaggacacggagtcacactcctaggcatgtgtggacaggctgcctacccacgggcaggacatggacatgctcaactatacgaggacactgcaggcacagtctgnnnncacatactctcaggtcacataaacacagcactctgtaacctcgagtcagtccctcacttggtcagtgagtgggctgaagcacccactggacagggtggctgagaaccaggacagggcctgggaagtgagtgatgcaatgaggttgggcggtaccaccccccacccaaccacccagtccaggcttcccacataatcgggtcactaaacaaatcccagaggcccagcccagctgttgcctggctttccagaaacagaactcggttgggaatggcagctgcttggacaggtctgtccccagaaagccctgggcatggatggattcctgtctaccctctggtttccactgacacatttatctaccaacattttgtccaagtctcctcttctgagccctcaccagaatcacccttaatgaagagtcacagggagaagacgtccacccacacatcaggagacaggcctggaacagagccttcctgcacagcctcagaagggacccaccctggtgacaccttgatcttggactgacactcatgacctccagtactgtgagacagtaacattctgttgttgaaggtgcccagtctgtggtactgtaaaacagccctgggaaactaacgcagcctgttagcccacagatggtgaagggatggaatgctccacggagctccaggcttactatctacagcccccaaagtgtgctgcggacccttggtgggtgtaggtatgcaaggtaattttgggtggttnaaggtgaataatttcaattgacataataatgtatttatcttgctgggtaaatgagggataccaactgttaggaaccaggcaacacagcaggaggtgagcagccagccagtagcaaagcttcatctgtagaaacagccacttccatccctcgcataccgcatgagctctgcctcctgtcagatgagcggtgccgttagattctcacagaagcatgaacctactgtgaactgcgcatnncagggatctagattgcgtgctccttatgagaacctaatgcctgatgatctgtgactgtctcatcactgccagatggaaccacgtagttgcaggaaaacaagttcagggctcccactgattctacattatggtgagttgtgtaattatttcattatatattacagtaaaataatagaaataaagcacacaataaatgtaatgggcttgaatcatctccatatcatcccttccccttctcccgggtccgtggaagagttgtnttcaagaaaactggtctcnggtagcaaaaaggttgggaaccactggtgtaaatgctttaaggaatagttaagcagcttaaagtttacatgctacaaaaaatacaggtttaaatgctaataaaaatgggtgcaaatgaaaacactctcttgctgtggtccaaggaatcttaggcattctatcagaaagacttacagcttggagttgcagctgccctcccacatcctgtccactgtaacccntgcaacacacaaacacgcacacacacacangcacanncacacacacacacacacacacacacacacacacacacactgtgtttcatgccctcactagggtggcctgggagggaatgcgtgggttttttttgttttttgtttttttgagatggaatttcactcttgttgcctaggctggagtgcaatggcgcaatctcggctctctgcaacttccgcctcctgggttcaagcaattctcctgcctcagcctcccgagtagctgggactacaggcatgtgcaccatgcctgggtaattctgtatttttagtagggatggggtttctccatgttggtcaggctggtctcgaactcccgatctcaggtgatccgcccgcctcagccttctaaagtgctgggattacaggcgtgagtcaccgcgnccagccgggaatgcatgcttttaggagaaacgaagacaactcaggaccctcattctcctggtgtttgcgcaagtgccttctccgtagaccatgcttcagtctctttcttagttctccttcttactgaaagagaagcagagccccagcatgtacccagctgcttagggcccaagcaagtgcgcaagtttcctggggagcctagtgagtggaaggcactgcagatcctncccaaaagaggcgtcggttttttatggatcc

SEQ ID NO: 77700 - DNA, 439 bp, Homo sapiens
attccttcttatggctgaatattcaattgtgtgaacgtgtgtgtgtgtttgtgtgtgtgtatactgcacaatttgtttatccattcatctgttgatagacacttgggttgtttcccccttttagctgttgtgaataatactgtgaatgttggtgtacaagtttgaatccttgctttcagttctctcataccttagaatgaaattgctgaatcatatggtaattctaagtttaactttatgaggagtcaccaaactatttttcacagcaactgcatcagcatttacatttctatcagcagtgcacaagggttcccatctttgcacatccacaccaacaatttatgttttttaataatcaccattttaacaaatatgaagtataatcgatgcattcttaatttcctcttagtttttaagactaaatgagtcagttggtgtg

SEQ ID NO: 77701 - DNA, 380 bp, Homo sapiens
ctgtgaactctactgtcccaggacaatgggactaggacttggggttcactctgccacactggtccttcctgttctgtttattgtgcgcagtaaatcaactctcctgtttgcgcagcggttctgtgttctagattatttataagattgaaatccattgtttatttttctcagcaggtttattgagccagtcaagaataaaatactgtcttaagcagtagagtaagccattagccaattgcaacttggcttcaaattaatccctaaagggtgtgcacatgaacacacacactttgtatgtcccacatacatgtgtgtactggaggtgagagccaggggaggtggaggagctttagtggtgccagatctctgcagctttgtaa

SEQ ID NO: 77702 - DNA, 283 bp, Homo sapiens
tttctttttcctcttttaaaaaaaaaaacataaatagtggtatactatacatactcctctgcaccttgctttttctattaattctattgctagttctatttatttatattcagagaattttccttgtcagtacgtaaagagcttctactttttgaacatgtacatagtatccaattgtaaagctataccacagttagtctcttattgacaaatatttgttatcacaatgctgtaagaaatctatctatctatctatctatctatctatctatctatctatata

SEQ ID NO: 77703 - DNA, 559 bp, Homo sapiens
tggggagttgcatcttcatgaagatctttcaccacaaactccaccagatgctccagggaagactgtggagtcctgacaaagatgccggggggcatagaaaggtgatgcaaaaatcaacctggatccctctgccccattttcccatcacaataaagttgtcatctgctggggggtaagatgggcaacagaactgtcttgcagctgagggaagggaagagaataaagactgtcagccctggaggaggggtgagaatacatatcagatccaaacctccagctggagaagaggcatggttcttgtggaggccatgagacccagggatacaagctgtaagaccaagggataatcaggacatcagaactccgtccatcccagggcagcaaataagcatcagttaaaagtaatattgaaacattactaggaagcatgcatgagacaggctctccctgaggatcagggaaaagggatacgtaaagctgaagatggggcagactttgagaagaaacctctagaaactcagactccataccaaacccaaggtattgctaggagagtttg

SEQ ID NO: 77704 - DNA, 626 bp, Homo sapiens
gttacaggcagaaacgtgattatatacattctctgaagttgctaaatgtccttgaagaatacatcacagacgagcagaaagaggaagaagaagaagagggagaagaggaagaactaattagaatatttcaagaacaacagaagaagtggcaacaatatagaagtgttaggagagagaggctgaaagagatgaagctgctacgtgaccaattcgtaaaggctcttgaggactttgaagacctttgtgacagagttttttccgatgaagacagtgaacttgataactagacatgtttttaaataaaatcatgtcagaactcttttggaaaagttggcacttacccagttgtctcttcaacctctgttattctgatgactgaagaaagaacttgaacctatgttatatgatacaagcacaacttgagctacagtaaactacatgacagtgttttgataattgttgtataaatcggtatagctcctctgtcactcgtctgttaaatgccagacctcgtttctatgatctgttgaatgaatcctagacacttctgtgagaaagcagggattgcatagttatgtacacggtcaattaaattttaacattaaagataatttagatttcgaaaa

SEQ ID NO: 77705 - DNA, 372 bp, Homo sapiens
gctggtcttgaactcctgctcttaagcgatctgcccgcctcagcctcccaaagtgctgggattacaggtgtgagccaccacgcccggtctgatttttgtattttttgtagggatgggggtttccccatgttacccaggctgctcttgaactcctggcttcaagcaatccacctgcttcggcctcccaaagtggtgggatttcaggagtaagccactgcacccagccttgttcatttcaatattcctgatgaagtactccatctgatctcatttgctcttagaaatctgcttgctggttaccctgtgcagtggctcacacttgtaatcccagcactttgggagactgaggtaggaggattgcttgatgccagg

SEQ ID NO: 77706 - DNA, 329 bp, Homo sapiens
tggaagaaacatttctccaccctaactcaatatttaggacttttccactcccagacctttcccctttcctttccccttgctccagcgtccataaaatcccaagagcctttttttggaagctcctttaggagtgagccagataccgtgtctatgctagtcctgctaattcttgactggtgctggtccatggaaaaaaaattgatcaggaggagtcaccattttcttcaggttaacctcttgcttatcctgtccctgtaagtgattaaaggtttcactgttactttcatttttgcttcttgcttcatttttgcttcttggctactctgata

SEQ ID NO: 77707 - DNA, 478 bp, Homo sapiens
caacctctggctccctactgatgaataaaactttcattagcctgtcccccaatcctgcactcccttcccaattatcatccaattgttttctctccatcagagacaaacatttgtttagggactatttcaaacatacttaaaaagtacagagaaccatgtagtaaacaaagatttaacagacattgacattttgccatatttcactagggttttcccgtttatggaaaaaaaatgcaggccgggtacagtggctcatgcctgtaatcccagcactttggaaggttgaggcaggtggatcacttgaggccgggagttcaagaccagcctagccaacacagcaaaaccctatctctactaaaaatacaaaaattagcagagagtggtggcatgcacctgtattcccagctactcaggaggctgaggcatgcaaatcacttgaacccaggaggcagaggttgcagtgagccaagatcacgca

SEQ ID NO: 77708 - DNA, 464 bp, Homo sapiens
atgcgagtgtggcccctttgcattacgagctgccggagccagacctcagaacttgcttggacgcggtctgcaaggggctgggcgtggggctgaacggcttctcttcctctcctgcagcagagccacagcacatgcacaccttaccacaaagctcccgtcttcaccactcgcattcctggccaccagagagggtcctgcccaagggcaccctgcaacatcgtcatgcttcatcgttgcaagggccacaagatgcaccagggctgagatggcaaccaggagcaaaggagtgcctggtgaggtgtactctgacatggacacaaagctgataaaagactgcctggtatgccagagagagcaggatccctggaagagatggccatctggacttcccaggaccacaggccaagcacagtggctcatgactataatcccagaactttggaaggctgaggtgggtagatcac

SEQ ID NO: 77709 - DNA, 678 bp, Homo sapiens
ggatgaaggggtcatttttcactggtaggctgaaaaatgaccccttcatcatcaggctctgcgttctaccaaattgtatgtaaaaagacacatctgttttgtgataggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactctaaaagccctaagtagttggtaacttcctgggccttcaatcatagcaatttgatgagggaaggaaggggagaggatttgttgggtaatcaagacattcccgtatatgtctgatttcatggaactgctctattttgtttgtgtgtattgtatatgtatatgtgtatgtgtgcgtgtatgtgtgtgtctgtagcttcagtttttaagtgtaaggactaaataaactaactgaaattttactttcagaaggaattctgaagttttaaaaaagttaataatagctagaatatcttgctgaaaatgtactataaaattttgcctgctgggcgtggtggctcacgcctgtaatcccagcactttgggaggccaaggtgggtggatcatgag

SEQ ID NO: 77710 - DNA, 3393 bp, Homo sapiens
  misc_feature (1053)..(1053): n is a, c, g, or t
  misc_feature (1056)..(1056): n is a, c, g, or t
acaaagtcttgctctgtcacccaggctggagtgcagtggcgcaatcacggctctctgcagcctcgacctccggggctcaagctattctcctgcctcaccctcctgagtagatgggactacaggtacgtgcggctatctagctaattttttaaatcttaagtagagacattggtctcactgtgttgcccagactggtcttgaactcctaggttgaagggatcttccagcctctgcctcccgaagtgctgtattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatatnttnagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctagagacaactttgggtggatccatgaactctgtgtctaaactgatccactatgtagggtggctatccactactgcaatgcgcttggagagcaacaatactttcttgctgcactttattttggatttctatgagaaggtgtgtgacatatatataaattataaccttccattagtggtattgtttcctcctgggatcttctattctgcactcctcagcctggataccagcatcctgaaccagctgtgttttattatgcacagatatcgtaaaaatttgactgccgcaaagaaaaatgagttggtacaaaagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacaggaaagcccagaagaaaggacagtaaacgtgagctctattcggggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactgaacacactggactaaactcactcctcattgctagagcaaagtggctcatcttgagttcccattttcatttcactgacagactgccatcctcaaggagtactcagactggccttctgttcatggcttaggagagccttggtgtgcctaactgatttttcaaaatttagatttttttagcctaccagtgaaaaatgaccccttcatcatcaggctctgcgttctaccaaattgtatgtaaaaagacacatctgttttgtgataggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactctaaaagccctaagtagttggtaacttcctgggccttcaatcatagcaatttgatgagggaaggaaggggagaggatttgttgggtaatcaagacattcccgtatatgtctgatttcatggaactgctctattttgtttgtgtgtattgtatatgtatatgtgtatgtgtgcgtgtatgtgtgtgtctgtagcttcagtttttaagtgtaaggactaaataaactaactgaaattttactttcagaaggaattctgaagttttaaaaaagttaataatagctagaatatcttgctgaaaatgtactataaaattttgcctgctgggcgtggtggctcacgcctgtaatcccagcactttgggaggccaaggtgggtggatcatgag

SEQ ID NO: 77711 - DNA, 2344 bp, Homo sapiens
  misc_feature (1034)..(1034): n is a, c, g, or t
  misc_feature (1037)..(1037): n is a, c, g, or t
ctttcctaggaacctaggaaataactcggaacctgtaacgtcccactggtttggacatattcctctcctgatctggcctcatctgttccagggaggtgggattgagcctagtgcaggctacagtcaaacctcttctggacttctgcgacagccttttatttggtttcttgccgctccttgacctctaacattctcgtctctgcactgcagctaacatgatcgtcaaacacaaatcagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatatnttnagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctgtgagttatctaacggtcttccacaagagacgatctgtatacaaatgtttgcatatgtttaatagtgtggcgtgaaacaatttttttcatgtaaatgcttagtagtacttttttggaagacttttttgtgacttttcactcttcttcccccacaatcctgaaaggaaggctaattctctaagttcctattgtgtaaatcagaaagcaacccttatctgctaaatgacttctttcaagagttaatataacaaaacactagagagatgagactagaatttgcaactttgacttccattcagtttaactcattttataaattatattcttatatttaaagccaattttcatgatggctagaaaaatctctaacgtaattttgcgtacaactttgtttttatgtttctgtgctgtattttggttatatgtgttaatttatcttaactttggagtttaaaataagagccctaaattgttaaatgtgtgctttaccttcaaagtaaaagtaaaagactaaatttcaaggaactgc

SEQ ID NO: 77712 - DNA, 3351 bp, Homo sapiens
  misc_feature (1053)..(1053): n is a, c, g, or t
  misc_feature (1056)..(1056): n is a, c, g, or t
acaaagtcttgctctgtcacccaggctggagtgcagtggcgcaatcacggctctctgcagcctcgacctccggggctcaagctattctcctgcctcaccctcctgagtagatgggactacaggtacgtgcggctatctagctaattttttaaatcttaagtagagacattggtctcactgtgttgcccagactggtcttgaactcctaggttgaagggatcttccagcctctgcctcccgaagtgctgtattacagaacatatgcagtaatgtcacctcaaaagagagttaagaacgtccaggcacaaaacaggacttcacaaggtagtagtagttttcagaccacgctttcagcctggaaagtaaaacaggatccaagcaactcgaagaacatctcaaaacatggacaaaacaatccagtgggagattatgaacatgctgatgatcaagctgaagaagatgctttgcaaatggcagtgggatattttgagaaaggtcccattaaagcttcacagaataaagataaaaccttggaaaaacacttgaaaactgtggaaaatgtggcttggaagaatgggttagcttcagaagaaattgatattctattaaatattgcactcagtggcaaatttggaaatgctgtaaacacacggatattgaagtgcatgatcccagcaacagtaatatcagaagattctgtggttaaggcagtctcctggctttgtgttggcaagtgttctggtagcaccaaggtacttttttatcgttggctggttgcaatgtttgacttcattgatcgtaaggagcaaattaacttgctctatggcttcttttttgcttcattgcaagatgatgcactgtgcccttatgtttgccatttgttatatttacttaccaaaaaagagaatgtcaaaccatttcgtgtgagaaaactgcttgatcttcaggccaaaatgggaatgcagcctcatctccaggctttgttgtcactgtataagttctttgctcctgctctgatttcagtatctttgcctgtaaggaagaagatatatnttnagaattcagagaatctatggaagacggctctgcttgccgtgaagcaaagaaaccggggaccttctccagaacctctgaagttgatgttaggtccagctaatgttcgtcctctaaaaagaaagtggaattctctctcagttataccagtgctcaattccagtagctacactaaagaatgtggaaaaaaagagatgagtctttctgattgtctgaatagaagtggatcatttccactagaacaacttcaaagcttcccccaacttttacagaacatccattgcttagagctgccttctcagatgggctcagtgctaaacaactctctgctgcttcactacattaactgtgtcagagatgagccagtcttgctgaggttttattactggttgagtcaaacattacaagaagaatgtatttggtacaaggtgaataattatgaacatggaaaagaatttaccaacttcctggataccatcatcagggcagagtgcttcttacaagaggggttttattcctgtgaagcattcctgtataagagccttcctctctgggatggcctttgttgtcggtcacagttccttcagcttgtgagctggattccttttagtagcttctctgaggtgaaaccacttctttttgaccatctagcgcagctcttctttacatcaaccatttatttcaagtgtagtgtgcttcagagtctgaaagagctattgcagaattggctgttgtggctttctatggacattcacatgaaacctgttacaaacagtcctctagagacaactttgggtggatccatgaactctgtgtctaaactgatccactatgtagggtggctatccactactgcaatgcgcttggagagcaacaatactttcttgctgcactttattttggatttctatgagaaggtgtgtgacatatatataaattataaccttccattagtggtattgtttcctcctgggatcttctattctgcactcctcagcctggataccagcatcctgaaccagctgtgttttattatgcacagatatcgtaaaaatttgactgccgcaaagaaaaatgagttggtacaaaagacaaaatcagagttcaatttcagcagcaagacttatcaagaatttaatcactatttgacatcaatggttggttgcctgtggacgtccaaaccctttgggaaaggaatatatattgaccctgaaatcctagaaaaaactggagtggctgaatataaaaacagtttaaatgtagtccatcatccttctttcttgagttacgctgtttcctttttgctacagggaaagaaatggagctggtatttggactatttattttcacaggggttacaaggcttgaaactttttataagaagtagtgttcatcattcttccattcccagagcagagggcataaactgcaacaatcaatattaaatgaatgttgacataaactgaacacactggactaaactcactcctcattgctagagcaaagtggctcatcttgagttcccattttcatttcactgacagactgccatcctcaaggagtactcagactggccttctgttcatggcttaggagagccttggtgtgcctaactgatttttcaaaatttagatttttttagcctaccagtgaaaaatgaccccttcatcatcaggctctgcgttctaccaaattgtatgtaaaaagacacatctgttttgtgataggattttttcacatttttgggtactatgagctgcattgatggaagacagcaggcaatatgtggtgacagttaactcacagacataaacatgcaaaatactttgctgtctctggggatattgccatttttcttactgtgagcaacagcaccaacaccaagttaacaggatgcaacatgtgtatgactctaaaagccctaagtagttggtaacttcctgggccttcaatcatagcaatttgatgagggaaggaaggggagaggatttgttgggtaatcaagacattcccgtatatgtctgatttcatggaactgctctattttgtttgtgtgtattgtatatgtatatgtgtatgtgtgcgtgtatgtgtgtgtctgtagcttcagtttttaagtgtaaggactaaataaactaactgaaattttactttcagaaggaattctgaagttttaaaaaagttaataatagctagaatatcttgctgaaaatgtactataaaattttgcctgctgggcgtggtggctcacgcctgtaatcccagcactttgggaggccaaggtgggtggatcatgag

SEQ ID NO: 77713 - DNA, 835 bp, Homo sapiens
tagagagctagcaccatgaaataccctgctgccaaataaccttccccaaatacttgtttttatcatacttcttccttgcttaaaataaaatgataaaacataacaggatatagaatattcaagatttttttaattccagaattcaataattaagagaaacaatgtttttatatgaatgatgaagaaatatacatgtgtatatgtaacataaaagatattttcacgggtaagcaaatatatatataaagccctgtaatagctcaccatggcagcttggagcaatagttaaaaaaaagcacaggttcttttttggacggagtgggagatggaggtacatgggtttttaagtcacctggattcatgacctagccacaaaggcactgtgtacccttaaagagttacagcctttaaaagaggtttatatcctgatatggtttggctgtctccccaacccaaatcctcatcttgaattgcagctcccataatccccatgtgtcatgggagggaccatcaggaggtaactgaatcataggggcaggtttttcctgcactgttctcatgacagtgagtaagtctcccaatatctgatggttttataaagggcagttcccctgcacatgatctcttgcctgctgacatgtaagagatgactttgcttctccttcgccttctgccatgactatgaggcctccccagtcatgtgaaccgtgagtgcattaaacctctttttcttaataaattactcagtctcgggtatatctgtattaacagtgtgaaaatgaactaatacaatatctttctccatttttaatgtgatatttgtgaacatcttaca

SEQ ID NO: 77714 - DNA, 731 bp, Homo sapiens
agcgcacaaagctgcctttgctgttacaaacagccgacagagggcgccggaccagcggtaacggacccaccagcgaccctaacccgcggtcgccccttcctcaaggagacccgcgcttggggtccgcagagtggaggcccgggcgcttggggattagggtccgcaggcctcgtgagcagcgagtaaacgccgcctttcacggctctgactacagagggagagctctaccgccgcctcccccgagacatttttctcatggaacattttagcgagaccgttttaccaatgtgccagtgtattgaggggactgacggctcaaaatcagatcgtgccgtagtcagtgttagagattcagggccatttctgcggagaaagacccgaattcggagaaaggggaaaatcatgaacaatcaggaagcgagcttacaaagtgctgtccacctttcagtggacagggcaccccgggggaaaaggaaaatgtgtgccccaatgtaggtgattttattaagttttaatggttattttttcctacaacaaagtagttgaaaaaactgaaaactattaaaacacattattttaagtttaaatatgccaagaccagacttttttttttttttttgtaagtttctgattttaatgtaggcaaacatcagaatattttcaaaattacttttctgcttactcattttcaattaagaacattaccatgtttggcaatatctcatgaacca

SEQ ID NO: 77715 - DNA, 915 bp, Homo sapiens
  misc_feature (720)..(720): n is a, c, g, or t
  misc_feature (749)..(749): n is a, c, g, or t
  misc_feature (799)..(799): n is a, c, g, or t
ctctgcagccgtgaagcccccgcggggccctgcaggtggctggcggcacctgcacacggtggttctctgttcctttttcctcctcaaccactgaggttaaaaaaagtgttaaaagccaccctttttgtttttttgagacggagtctcgctctgtcgcccaggctggagtgcagtggtgcgatctcggctcactccgagctccgcctcccgggttcacgccgttctcccgcctcagcctcccgcgtagctgggactacaggcgcccgccaccgcgcccggctaatttttcgtatttttagtggagacggggtttcaccgtgttagccaggatggtctcgatctcctgacctcgcgatccgcccgcctcggcctcccgaagcgctgggatgacaggcgtgagccgccgcgcccgcccattttttttaaacgtgttggggtttgggtttcagccacaggccttctgcgatgagaggaaacccaggacgcgcagccccaggtcaggcccgcggaacagccgggcggactccggggctcgcagactcgcgacccgcgtgccatgaacctccgcgccggaggcggcagcagcgagcgcggggctggatccagcgtagcggggcggccgggcggatccagcgcagccgggagacagatgcgaggcggcggtcagcaggtgccgaacccacggcaggcttccgtggccagcagccctagaggaatggncatcctgtccctgcgagcccctgggcccnggcaggcgatgcaggtgggatgctatggaatatgatgagaaagctggccngttccggcaaggcccactcaaaccctttcaacaagcagtcgggcgagacagcatgagcaggccctggtgagaggcccggacgtcactccggaagaggccttgcttgagctgccctg

SEQ ID NO: 77716 - DNA, 616 bp, Homo sapiens
gtcactagaaaaattactaaaaacatgagaataggtgaaaatgagtgaggctcttcattatatatacgggaggggagggatggaccatttatgagaaaatggtgaaagcaaacatttccttgccccagcatttgatgaatatgatagtgaaaaacaagtgtccccctttggcctgaatgaagtaagggaggaaaaaatcaaattagcagaaactagatgaaatatgacatggggcatccatggtcaaagtaaaagcacagcctttttaatctctagctgtaataactggagaacatgagtccattcatagcacagaggtggtgtctagactaattacatacatgccgattctttcagcaaatcatagttctcaatgtcattttaatgattatacataaagaagaatcttctcactctcgcgtaggaataattacattcttcagcactttatatgccaaaaaaaaaggtcatttgtagttatagtgattaattacctttgttttctggccaaaaacacaaggtggacaataatgaactaattacatattaccacaagactctgatgttcaaaagtatactaatgataactgtcttcacagattttatgggatttacc

SEQ ID NO: 77717 - DNA, 213 bp, Homo sapiens
gactgggaaggataatggcagaaaggaaatacagaaagtttgtattaaaatatggctaatacaaatatgagatatgctgcattttaatgtactgtaggttaaatttgcaaacctattctgtagagtaagcatgtagcagtttgtgttgctttccattagtctgtgcctggggttacatgtataaagcagcagttcccccagactagtgattct

SEQ ID NO: 77718 - DNA, 841 bp, Homo sapiens
ttcacgggaagacaacggaaatccaaggaaagctacgaaggctgttatcagagaaaaatttcctcgaagcactttagctgtcactttgaagtgttagtgacatcctttggcagtgattaaatgtgccacatgccactaatcttgtttagaatccttaaagaggacagcagcccttacacaggatgcttcgatctgatgacgatggtgtttatgcagtgatgtgtggctcacaggcacgtatacaacaccatcaactcttccatctcatacctcatcagagctttccatctgatcccatttggagaaggatatcacacctgaggaatccacgtgtaagctattgctcttgtatgagttcaggtgcacacgcactgtggacgcacactgcactgtgccccccaacggctgacaacgtggagccgggatgcaggagcatccgccttctccaagcttctctcccacctctcactgtgatactgagcagaactccccaaagaaaaatcatttctcaactgtgaaactagggaagactaaccagatgtgatagcacactgtattctgatcgaaagtgaactattcttccatcatattggtcaagctttcaaaaacacttacctatacttcagggcgaaagattctcagcatcctctaacaaatgtttgcctcagaaccattgaaaagaaaaggtttagaattaatgacagagaacaatgtacccacagctgcattttgctcttttgaaaattagatatttttctgcagataatactacagaaccacaataaaagttatcatcatgcttcacatctagtaatgaacgtgaaacaagcaccctcgaata

SEQ ID NO: 77719 - DNA, 348 bp, Homo sapiens
gagctcgctctctttccgtgtggcctcagggtcttcccctctccactgagccactccatgtggttgcttcaacagagtagccagacttcttactagcagttcagggttcccaaaagtgcaaaggtaaaagctagcgatacttcttaaagactagacccggccgggcacggtggctcatgcctgtaatcccagctctttgggaggcagaggcaggtggatcacaaggtcaggagttcgagaccagcgtggccagcatggtgaaacccccatctctactaaaaatacaaaaaattagccagacatggtggtacatgcctgtaatcccagctgctcgggagactgaggcaa

SEQ ID NO: 77720 - DNA, 438 bp, Homo sapiens
ttaatctagttaatcctgatatcctcttgctcagcagagaatggtggttaagaccactaatttagagccagactctcagacaactccactacttcctacctaagtgactgaaaaactgggcctgttttccttttctataaaatgggaataataacctcattggatagttgggagaactgaatgagttcatacatataaaggacttagaacagcacaacactcaagggacggggttaggggagttgtttgttgtgtacctttcacactttttgatatttgtaatatggacatgaatctttcattttaaaaaaccaagcaaacaaaaaccctcccatcaaaaacatatgaaaatagagtgaaacacaagttaaagaatgaatgtggaaaaactctgaagataaacaaaatctgggtgacagagcaagactccatctcaaa

SEQ ID NO: 77721 - DNA, 462 bp, Homo sapiens
gatgacagggctgagtctcaccaacacactgagtaccttaaggctctcaggataatgggaaaaaaaagaaccagaatccaccccccgccccaccagccacacacacacaagtccacaaaggaacaggcacccacatgctgtaccctggggcccttccaaccctgatgcgccaactcccgacatgctgcctctagccttgacctttctcagaaatgatagcttagcggatgtttggcagatctcaacagtcaagccaagatccagctgcagtcaaaacacaatacgcctggtggagcctcttccaggttcaaacacgggaaccacgctcggagctggacccggacccgagcctcttccaggctcagacacgggaaccacgcccagagccggacccgagcctcttccaggctcagacacgggaagggaaccacgcccagagccggacccgagcctcttccaggc

SEQ ID NO: 77722 - DNA, 398 bp, Homo sapiens
tcagaatgaagccacctacgtatagtcagtcttggctggaaaaaggtgagcgctttcacctttttcagcatccctatctagtctttctgggtaggccaaactttgtaattattaccctcaatattttgtaaagttattctcccatatccaccctcaccccacccatgagtccctgagatcttacactcctgctccaaagtcctgcttctccttttatactttgactttggttgatgaacattttatactgctatcccccacccccgtgtctgggtgtagttttagagtacttccaattattcagttcctccattatcacttgtattatatacaacgtgccaccttatattttctgtcgtagtatattgtatggctccagaaaggtagcagggtataaa

SEQ ID NO: 77723 - DNA, 347 bp, Homo sapiens
ccccatctctcctctcttcccctcacagatgtgcacccccgccaatacccctgctacaccccccaacttccctgacgctctcaccatgttctcccgtctcaaggcctccgagagcttccacagcggtggcagcggcacgccgatggccgcgacagccacgtcacccccgccacacttcccccatgccgccaccagcagctctgcggcctccagctggcccacgcgggcctcgcccccgggggcccacagcaccaccagccacagccgcccctgtggactccaacacccccttctccggcttcagactggccacccctggccccccaacaggccacctcagaacccag

SEQ ID NO: 77724 - DNA, 267 bp, Homo sapiens
cggagatttggggccccagtgccactgccctcccccgccccgtccccgttgtgcgtcatgctgttttttaaaaacctgtttccaaatttgtatggaatggcaaactgttggggggtcggtttggggagggagggtttgcatgaaagacacacgcacaccacaccgcacgcacaagcaggcccggcgccggcgtccggggggcagaaggaggtgagctcgccggctcctcctccccgcggccattctgtcccctcctggggtgagggg

SEQ ID NO: 77725 - DNA, 393 bp, Homo sapiens
tttttttgagacagggtcttgctatgttcctcaggctggtcttgaacacctgggctcaagtgatcctcctgtctcaacctcccaaagtgctgggattataggcatgagccaccatgaccagcctattttaaaaaaaaacttaaattaaaattttttaaagagatggggtctgggtatgttgcctaggctggcctccaactcctgggctcaaatggtcctccaacctcaggctctcaagtagctgggttacaggcatgtaccactgcatctggctcatattcttaatccaaacaagatggtttctacatagtgttgcatagtgtacactcaaaaattatttaattttcagggatcacctgtgccagtgcaagagaatagaaacaaagacttacc

SEQ ID NO: 77726 - DNA, 691 bp, Homo sapiens
ttgactatctagagggctgattttgaaactgttataatgaaagatggtatttgaaaacttttgatgggggaaattgtcatcatatttatattttgaaaagtgtttccttatttacgcattattgacttcctattgagactcaaaattttaagtacaactggtaaagaattcaatggatcaaattcagtaaatctgaagtcactggaataaaggcccctaagaaaaaaaaatgtgtcaattttaaaggtctttcctaactgaagaccattttgtgatagagccaaaggttaataaaatcagtagtgaatgtagcaattttacagataagctattcacaacaagtgtagttacttgaataaaaagctaattcagttctaaaatgccacatgcagtagcagtgaatagctgcttttaggtgctttctggaggaggataaaatacagaatcacggcactcttctcttccagcgtccctggctgcctgtaaattgctgtgaatggggctgtgggctgacaggctctattaagacaaactgcctttctcatcggagagataaaataaatcaggtgtttagtcaaattaaaatacttcagctggagcaggccctggggagcactgatccacctgactaatctgagagaaactcaagacagatgtggtttggggataaagacgaccccatggaacaaaa

SEQ ID NO: 77727 - DNA, 893 bp, Homo sapiens
gggctccgaaaggagagcgtggtgtctggaggtgatcggaagggactggctggagtgtggcgggctgacaggtctgaggcctgaaggacttccgggaaccgcaaagcacggtgtgcctccgctgtcctgaagaaaaagccgcgcgcggacgactggccggcccgcgcttgcagctcccagaagttgacaggcatcctccggtgaccggtgtgagtatggcatcaggatgatttgactgcaagcaacagaaaaatcaaacaaaaatggcctaagccaagaagagaaatgattatttcacattccaagaagtttgggagtcgagtggttaaacggctaattaatctagagctcaacagtatcacccaggacccattttcactatggtggctaaagctctgcacccttcaggcttgcaccatggcagcagcagtgacagtaaagacacccttacaccacaatgctccatgaccagggagagggtctcctctctcctgcccctttctggaggctccaccgaagatttctcttcacattccgtttctcattcctgaagcagttgctggcaacagggatggacttaccgcaatgggtacagagcaactaagattcaccactaggtgagtcctttggaaaacacttggccatccaatatataaacaaatctggtactcctgtcaggaaagaggtaggtaattcccaacagccaatagtgtctgccacaagtgaaatatctcatcagagaaaactgagtaggtaatacatgattctgtgttttctctgttttctgcctttgctttttccatttggtaagactcacctgtgttcctctttgtggctctttctccttgataatacaaccctggtttagttcagatacaggtggcaataggcca

SEQ ID NO: 77728 - DNA, 235 bp, Homo sapiens
tgagatttcaccaagttatgtctaggtgtgtgtcatttaaaaaataaccctgtctgggacttgggcctttcaatatgcaatctaaagtcttctggcaggtcagggaaattttcgtctgttattttttaaatagcacttctcttccatctgttctctctttctttctctctttcccgggcctcgacttggagcctggagctgcgcttagtgttgaaatgcaaacatgaacaaggct

SEQ ID NO: 77729 - DNA, 752 bp, Homo sapiens
agctgggattacaggtgcccacgaccatgcctggctaattttgtatttttagtggagatagggattcaccatgttggccaggctggtctcaacctctggacctcaggtgatccacccgcctcggcctcctaaagtgctggagattacaggcatgagccaccacgcccggaccatgatgcagatttcaagctatgaacatgattctctggagtttaccatttgtcttttaattggcaaatttgatgcagaattgggaagagaagcacacaattgactctcgtcagctggcacaagctggtgccagtgcaccactgtatatatccatggccctctgtgaagctagagtttactactaaaatttgtgctccataaatatacaaaggcactagtaagagaaaaaatataaagagaatataaactaaattcaaattagggagctcaaatggagaaaattgacagataatatttttgaaactttgaaaagtagtatttgtctagattcaccttttattaccttttcctttttttcttttccttttttttttttttttgagacggagtttctctcttgttacccaggctggagtgcaatggcacgcaatctcagctcattgcaacctcggctcactgtaaccttcaccttccgtgttcaaatgattctcctgcctcagccttccgagtagctgggattacaggcacccaccaccatgcccagctaattctttgtatttttagtggagatggggtttcac

SEQ ID NO: 77730 - DNA, 636 bp, Homo sapiens
agctgggattacaggtgcccacgaccatgcctggctaattttgtatttttagtggagatagggattcaccatgttggccaggctggtctcaacctctggacctcaggtgatccacccgcctcggcctcctaaagtgctggagattacaggcatgagccaccacgcccggaccatgatgcagatttcaagctatgaacatgattctctggagtttaccatttgtcttttaattggcaaatttgatgcagaattgggaagagaagcacacaattgactctcgtcagctggcacaagctggtgccagtgcaccactgtatatatccatggccctctgtgaagctagagtttactactaaaatttgtgctccataaatatacaaaggcactttgggaggccgtttcttgtatttttgaagttcccaagattagctggagagtatttgataacactctggctaatctgtcaagaagcgggggagaaaacctgccatctatttaatagcttttaagcagttcaatttctgtaatgagaagataaatctggaaacacccaccagagggatgcctctacaaagtcctgatgctgcaaaagagcatctttggagctacacatcaagagagcagcgactctcgacc

SEQ ID NO: 77731 - DNA, 403 bp, Homo sapiens
ggcaagattcgcaatctctctagggttcgctgcctccctctttgaaaatgtacctgttgagctgtgatgatcctgaaggtcttttacagctccaagattctaagtacatgagctgaataagaggggtcacactgaagaggttccctgagaaactgaccctcaataaaaacggtcgaatcaacattccataagacaaaatgagttataagacagatgtcaattggttggctcaaaatcattagtcactagagaaataaaaatcaaaaccacagtgtgataccatttcacactcaccaggatggctatttaaaacaaaacacaatgccaggtgcagtggctcacacctgtaatcccagcattttgggaggccaaggcaggtggatcacaaggtcaggagatcaag

SEQ ID NO: 77732 - DNA, 502 bp, Homo sapiens
ggtggccccaggcctcccgggggtgggaagagccaggctgagccttataaaggactgctctttgtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgacaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccaga

SEQ ID NO: 77733 - DNA, 442 bp, Homo sapiens
ggcttggggtgcaggccagcccagactgactactggctgaaagatctgctttgggaagctttttgaaagcaaagatgagcaacactcaagctgagaggtccataataggcatgatcgacatgtttcacaaatacaccagacgtgatgacaagattgacaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccaga

SEQ ID NO: 77734 - DNA, 425 bp, Homo sapiens
ggtggccccaggcctcccgggggtgggaagagccaggctgagccttataaaggactgctctttgtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgacaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagccatttaggtacagcctttaggtacagccatttaggta

SEQ ID NO: 77735 - DNA, 1137 bp, Homo sapiens
ggtggccccaggcctcccgggggtgggaagagccaggctgagccttataaaggactgctctttgtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgacaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccagaaaaagaaaaaaaaaaaaaaaaaaaaaaaaaaacacaaaacacaaaaaacaaaaacaaaaaaaaaagagagagagaaaagaagaagaaaagaaagagaggaagaagagggaagagaaagaaagagaagagaagaggaacgagcaaagaggcgagaggcgaccagaacacagccgacagaatcaaacagaaggagacgaaagcaagagcgagagaaggaacaccagagagaaggagaaggagagagccgcgagcgaacagagcgaagacgcgagagcagggaaagaagccacagagaacacaaacgaaagacagcggacgagaaggagcgggagcaacaacaagggagaggaggggaggagaggaggaggggaggcgcgacagacaggagagacggagggggcaggagcgagagaaggaggggaacgagagggaaggacggaggggcgacgggaggcgggcgagggggggaggagaggggggaaaggagaaggcgagaagagagggggaggagaacggggagaccggaggaggaggagggggaggggaagggaaggggcagggtggggggggagggaggagggcggggggggggggagggcgggggggaggcgggggggggggggggcgggggggga

SEQ ID NO: 77736 - DNA, 529 bp, Homo sapiens
ggtggccccaggcctcccgggggtgggaagagccaggctgagccttataaaggactgctctttgtccaaacacacacatctcactcatccttctactcgtgacgcttcccagctctggctttttgaaagcaaagatgagcaacactcaagctgagaggtccataataggcatgatcgacatgtttcacaaatacaccagacgtgatgacaagattgacaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtccttgctgggagacatagccacagactaccacaagcagagccatggagcagcgccctgttccgggggcagccagtgacccagccccaccaatgggcctccagagaccccaggaacaataaaatgtcttctcccaccagacacttgccttattttcttcttctcttt

SEQ ID NO: 77737 - DNA, 345 bp, Homo sapiens
aaataacttgtggattaaagaagatgtcacgagggaaatcaggatatattttgaaataattgaaatcagaacacaacatatcaaaatgtgtgggatacagctaaagcaatgtttagagggaaattaaaaccattaattattagaaaataaggaagttctcaaatcaataatataaatttttatcttaagaaactaggaaaaaagaacaaattaaacctaagtacacagaagacagtaattaagagcaggggcaaatgaaaccataaacagaaaacaatagagaaatcaaaagctggccttttgaaaagatcaataacattgataacctatagtcagattggtcag

SEQ ID NO: 77738 - DNA, 344 bp, Homo sapiens
caaagcctatgctttgcttaacacatagaatggaattgcattaatgtgagaaagcatttcgaaaatgatggagtctgtagagatgctaggaattgttttcatgatcattacctgaagcttcatcctaaaatgtgctgactcttaatttaagtatatgcaacccaaagttatctaggcctgtcagcctcagccttaagctctagtcttagcactgtgatgcatgaagagaaatgtaatttctactccaaaagtgttttaagataacataagattggccgagcgcagtggctcacgcctgtaatcccagcactttgggaggcagaggcaggaggataacgaggtca

SEQ ID NO: 77739 - DNA, 394 bp, Homo sapiens
gtatcaactattaggaagtggttaaacaagattaaagtgttttgatatgtattaacattgaaacagtgaagtagaggagaatagggctaggggaaggtcaaaaaatattttagacttattcataatgttgaaacttttaacacaatgactacattaagatatgtcagtctcctagggtatcatttcctgtcctcaactttgccaattatataatcagatgctataagcaggtatatttagattctccagaaaagaagggtttgcttcattttcttaaaacaattttaggattgtgcagcatttttgagcttcaacaaaaattataaacctctctctaggaaagacatacacaaaatacagatatttttctaaattaataaatgtttaggagaaa

SEQ ID NO: 77740 - DNA, 482 bp, Homo sapiens
ataataattcttagaagaattgtgttttctcaacacaccctcctgagatcgcccccttccctgttttattgtgaacctttcctatttttctaccccatgccaggtgtttctaggtgtggcaaatatttctgtttctttcccatcatgtagaggtgttgccggggcactcacaggaactgcatttcccaggttcccttgcacctcagtagggccatggaaggcttctcagctgtggcaaatgcatggaagtaacaactggcaccttcagcccaaaggtaacatggagatgtctcttccccttggtgcctccctctacccactggcagaatgcagagaacaccaaggacttacagaaggcagagcctcatgatggaaggagcctggatccctgaatgaccatctggaaggctgactgaccaggaacatcctcttgggactgtgaagtatgcaagaaataaattttcattgtgctaaggccctgg

SEQ ID NO: 77741 - DNA, 455 bp, Homo sapiens
ggtcttctcttgaaaatgggaggataaggccaaattggggccagattctcacatggcaacagctaggtagtgactgccttcctatatggggcacaacttcctgttcacctgagaccctcctggcctgtgtccccatccacattgcctgtctggcacctataagcatttagtctaaattctactaagcagagacatctgttttcttctctaagggcacaacttccattaaaactaatcttttggtcctagggaagccacatggggaagaggcatacaaacacgggcttctgagttagataaacctaggctgaaatctcagctttgttctttgttagcagagtgagcctggacaaattacttactcccaacctcagaatgggagcaataatatatacacctgaaatggtggttgtaatgatcatgtgagagaatgtatcagaagcagctagcacata

SEQ ID NO: 77742 - DNA, 276 bp, Homo sapiens
  misc_feature (23)..(23): n is a, c, g, or t
gaaccaaagccacagttgggcangctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattaca

SEQ ID NO: 77743 - DNA, 939 bp, Homo sapiens
aatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcttttgggtggaaggttgtgatttttactgggaggacttgagtagaagtggatgattaaaattgaggagtatataattctttctgggactgcttaaatgttattgtttgaaaatgccttcactttccccctttggtcaaagagatgtgcttaaaattcttattccttcacaataaataattttgattttcttagacaggtttgtgtttaggtatgagtttctcttttacttcatctagcaattctctctgtggtcagaagaactctgaagaaagctttgagggaaatgaatataactcttaaattattatatgtgtgtgtatatatatagtttaactttaaaaataatttattagtcatcataaagaaataaatgtctctggctcaa

SEQ ID NO: 77744 - DNA, 732 bp, Homo sapiens
ggcactctgtagatctttcataaaaattttttgagtgaattaatgaattcataaactattcattaaatgattactctgtgataactaatgacagtatcagttaacatatattgacattaccacacaccagggattcttctttttttttttttttttggagagtctccctctgtcacctaggttggagtgcagtggtgcaatctaactgcagcctctacctcccatgctcaagcaatcctcagcctcctgagtggctgggactataggcacatactaccacacctggctaatttttgtatagatggtgtttcgtcacattgcccaggctggccttgaattcctgggctcaagtaatcgcctgccttggcctcccaaagtgctggaattacaggctcagccctgggggggttattctaataacttgataggtactattatcattttttctcacaataaccctatgggataacatctcagaaactgacaaattcagaaatgtgtcagttcctgaaaaaggaaactttgggatggttggctgtacttttaaccactactctgtcttgtctctgcatgtgtgggcatgaactttgttaggttctgaggaggaggatggggggttgggaggagctgcatatgttctctgccccagaagaatcatggcccaggggaagaggtagcaaaaggaacaactattccagtatgacttgatcagtttcttgatggacatgtgtg

SEQ ID NO: 77745 - DNA, 509 bp, Homo sapiens
acaaatttaagtcattaatgttactgattggagttcatttctcagatttcacatagttgttgggcacagaaaatttggaaactttggctttcattcttgcacagactaatttagcatcatattcttgttctttgctgatttatcaggtaaggaaaaagtcaagtaaaatgatttggatgcctcactgccagggaatgcttgataaattaaaagcctggcttcctagggacattctgactactgttgtttataaccaagatcttttgcaaccttagacttcccaggaaaagcctgggctttgttgctgcaggaaggagaacagggaggaaaatatctttcagatttaatcagtgagaaactactaggaattagccactatgctagggaatacccaatcattattttgatacttttgtaagctgaagcatcatttaggggcctagcaggtttgctttctgatcatattcaaagccttcacctgggtgaactcctgtgagaacctataattc

SEQ ID NO: 77746 - DNA, 765 bp, Homo sapiens
caagattattgtcaatccctgaatgtctggagttacctcccatggatttttttttcctttggcctgggttttataaacaacttgaacatcatatcatataggataacaaaggaggaagttaacttaattcacctcagacttcagcctaagattcaatcaaattcatccttcagcctgtcttgtttcttctttatgtttcttttacttattgctgctaggatcctacataggatttctatagaaatgtatgaaattctgtggtcactgcatgtcaggattgcacagtatgttacaatacaatttcaaagagaacccacatttgtgagatttacagaccaaggtgtggtggaggaggtagaattgcagatcagataaaaagtgagcttacacttgaacttagttattcactgtgacctaaatttagtcctattgtaatatgtgcctgtcacaacacaaatacccctcttgaaagagatttactcatctatccaagcacttaatttggaaattttattgtcctattgcaaaatgaaacaaaattaaaagtggcctcgagtacttggtaagttacttaaaatttttacaaaaatatcccactcaatgccaaatctttcagtcctcaaaggcatttaagtccaatagtcatgctttaaatatggctttaaattatgccaccaaaatggtgcacttcacagattcaccagactgtagcatcataaagttaatttacagtttttacaacattgcttctacattcttactggt

SEQ ID NO: 77747 - DNA, 411 bp, Homo sapiens
tttttttttggtgggagattttgaatactgatttaatattctcacaagtttctattcagattttctatttcttcatgatttagtcttggtaggtttcttcttgttgctaggaagttgttcttgtaggttatccaattttttgtagtataattgttcataacacgtttataatcctttttatttctataaagtcagtagtaatgtccccacttctacttctgattttggtaatttgagtcttctcccttttttcttagtttatctagccaatgtttgtcaattttattgatgtttttaagtgattaacttttgatttcattgattttcaccattggttttctattctctattttgtttatctctgctctaatctattaattccttacttctgatagtttgggtttaatttat

SEQ ID NO: 77748 - DNA, 1163 bp, Homo sapiens
attaatatagttaactctgcttaaacacagtcaatatatttgtggcactctttgcacattggaattaaacaaatcttcattcctttttcttctttactcctatacccaatcaatcatagtttctttcaattgttcttaaatttcagatatttcagttttccatctccattaactcattgtaaccacctgattcatcccatatccatttttttctgatttattaatccctaaaagatctccctaaacttgaggtttgacccctctgcaatgcagtgaaaatgagtgtgatagctattttttgtgtgtgtgtcaactttaccaggatactgaaagaactggtaaaatcattatttctggctgtgtctgtgagaatatttctggaaaagatgaatgtttgaatcaggagactgagtacagaacatcttccctcatcaatatgggcaggcatcatccaatctgttgaggacaaaaaaaaaaaacaaaaaaatttggaggaagtctgaatttgaagtaggagatgggactcaactccaaaggtggggcttgaacatgggaccaaattgaggactagctaaaacaggtcaggagtggaaacagctttcctaaacacacgcctaccagtatgccatgagagtttaccattgccatggcaacacccagaagttaccacccctttccatgacaatgacccaacaatctggaagttaccacccttttcccagaaatttctgtataaactgccccctaatttgcatataattaaaattggatataaatactgcagaactgcctctgtgctgctactctggccacactgcctacggggtatccctgctccacaaggagcagtgcttctgctgctgcttcagtacactgctgcttcaataaaagttgctttttaataccactggcttgcccttgaattctttcctgggttaaaccaagaactcttctgggcttagctgtcattttggggcttgcctgtcctgcagcaaattcattgtctctccttaagctggaacattcatcttctcttgccttcacccatgggcagttcttgattattaggagttcagcctaagacagggagttacgccactgactcctgtgattctcagaccttcggacttagactgaattatgccactagctttcctgggtct

SEQ ID NO: 77749 - DNA, 273 bp, Homo sapiens
gctggttgtgtagccatagactggcgccggactctgaactggttattactggtctgtaatgagataagcccacacactgtatttagaaacttttatagaaacttgacagagtatacaaaaaaattaaccgggcatggtggcacatgcctgtaatcccagttgctcaagaggctgaggcaggagacttgcttgaacccgggaggcggaggttgcagtgaaccgagatcatgccactgcactccagcatgtgtgacagagccagactccatctag

SEQ ID NO: 77750 - DNA, 311 bp, Homo sapiens
acagctgtgtctgcagttggtgggaccccatctcatgaaagcacgagcgcaagggcgagggctgctttctattctagtctgatagtctgacgggctggaggagtccgggagagctgacaggggtcttaaccgccagcagggatgggcctgaatacagttgggaaatacctacggggtccaggcagaggactgcacaagccactcaacatgaaggtgaaggaaaaggaggctcaagaacggctctgggtggggctggggccgggtgcggtggctcacgccggtgatcccagcactttgggaggctgaggtgg

SEQ ID NO: 77751 - DNA, 746 bp, Homo sapiens
caaaaacaaaaaaaaaaagaagggtgattatttactttacccaaagacctataaattactacttcatatcctaagacatttcagaaattaaaatataaacatcattactctaaggcagttccttaataaggaaagcttgtttatagcaaaaataagatatactaaggagaaagtttcagataagtcctttagttacttttaaataaatttgaaaaaaaaatttttaacatttctattacagaaagttttaaaaattgaaatatactgaataacattttcattcaaaattgtcataactaattcaattaaaattttttaaatacaagtactgtcatcagtaataactaacattcttttaatggttattatggaccaaatattcatgtcaaacactatagcagccccttaaagtagaatcattattatatcaattgcacagattaaaaaaaaatccaccgtgcccagcctaatttttgtattttagtagagacagggtttcaccatgttgtcccaggctgggcttgaactccagagctcaatcttcttgcctcagcctcccaaagtgttgggattacaggcgtgagccactgccctcagcccattttctttaaagcagtaataaatgtatcttttgcgattttccagtctcagcatgtctttcatctgacagcagatagacacacagctctttctctgagaggaatagagactggttttgaaaccgagctctgtgtatagtgtttgaa

SEQ ID NO: 77752 - DNA, 642 bp, Homo sapiens
  misc_feature (555)..(555): n is a, c, g, or t
  misc_feature (602)..(602): n is a, c, g, or t
  misc_feature (609)..(609): n is a, c, g, or t
caaaaacaaaaaaaaaaagaagggtgattatttactttacccaaagacctataaattactacttcatatcctaagacatttcagaaattaaaatataaacatcattactctaaggcagttccttaataaggaaagcttgtttatagcaaaaataagatatactaaggagaaagtttcagataagtcctttagttacttttaaataaatttgaaaaaaaaatttttaacatttctattacagaaagttttaaaaattgaaatatactgaataacattttcattcaaaattgtcataactaattcaattaaaattttttaaatacaagtactgtcatcagtaataactaacattcttttaatggttattatggaccaaatattcatgtcaaacactatagcagccccttaaagtagaatcattattatatcaattgcacagattaaaaaaaaatcaaaaaactcgagactagttctcctcgtgccgaattcggcacgagccaaagcagcagctgtattgccgcagttctagcttcaccttcacgatgtttccttggntccagaggcaccagaaacgtacacctgattttatgacaaatacggtnatgctgnattagctagtggagccactttctgtattggtac

SEQ ID NO: 77753 - DNA, 140 bp, Homo sapiens
gagactccatctgaaaaaaaaaaaaaaaagtataaatagttatgactgaacaactatgaactgtataaaaatatcccattaaactcatagtgaaagtatctccaactaaaaaaaaagaagaaagaataaaaaacacattt

SEQ ID NO: 77754 - DNA, 1628 bp, Homo sapiens
  misc_feature (707)..(707): n is a, c, g, or t
  misc_feature (710)..(710): n is a, c, g, or t
  misc_feature (719)..(719): n is a, c, g, or t
  misc_feature (722)..(722): n is a, c, g, or t
  misc_feature (724)..(724): n is a, c, g, or t
  misc_feature (727)..(727): n is a, c, g, or t
  misc_feature (730)..(730): n is a, c, g, or t
  misc_feature (733)..(733): n is a, c, g, or t
  misc_feature (747)..(747): n is a, c, g, or t
  misc_feature (753)..(753): n is a, c, g, or t
  misc_feature (756)..(756): n is a, c, g, or t
  misc_feature (758)..(758): n is a, c, g, or t
  misc_feature (761)..(762): n is a, c, g, or t
tattttcatttaccgggcggtttataatacccacagcttttttaaggccgcactttcggcattaaacaatttctctcggattccatatttagaaaaccttccccctttgaggagtataccccccccaaacaaaacccgggcccagtttttgtcgcgcaacgaaaagccaaatgacaaaacctttcccggggtgtggcatttaataagcggcgtacacaaagtttcccaaatgaaaaggggaattagcccaaccaaattatgggagttcccacatcattgggccccccgagtttaaattttaagctccggtcccaaattttgtgggaatttgtggcggaataacaattcacacggagaaacgcttatgacagtattccgattttaaccggctccattttgggaaatttgccctagaagtcaaaaaactggccaggggggcatctcttgatggccgttaacaatttggtaaaaacccgggtaagaccgcaaaatttattaggaatgtgaacccccctttggggataaaattttgtaccagttggagaaggtctcttccttaaactggggaactcttgttaccccaatttcttcttgaaaaacggtaatttaagttgaggcaccttaaaacttgccattgtggtgcctcttgaaactgggccctctggttcggtaaaagccaacttgccccttcccaacaccaatcagcnagntgagccccnacncntgnccnagntccaggacctgccnctgagncgngnctnntagtcctagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccgcttcctggacttcgtgccttactgagtctctaagactttttctaataaacaagccagtgcgtgtacaaaaaaaaaagaaaaaataaacaaaaaaatcaacaaaccaaaaaaacaaaaaaagggggcgggcgcggccataaaaagtatatcccccctcaggggggcggccagtaatgacagcagtagcacccaggttttctttgaccacagagggggcgcccctatcagagaggcggctcggatatataatatagacgaagaggagcggccggggcggccgcggcgtacaacaacgcgctgggacacggggaaaccaactcggcacgcacggtggggagaactctgtgtggggaaggaggaccccttatctttgtgctgtggggggggtgaacacatatagttgcggacaccaactacactctcagaagagagaattatagaggcgcgtctgaggggacaaatattataacaaccttttcaaggggcgtttctaagaggggtgctgtaacaccaccgccgtgcaaatatgtattctgcgcggcgtgaagaagaagaattttggtctagcgggggtaagtagtaatttcgataaaatattttttgtc

SEQ ID NO: 77755 - DNA, 2343 bp, Homo sapiens
gcagacaggttgacctgcaaaaaaagacaggggaggcatggaaacaaaggacccatcgcaaatgttttccatgctgatctccaaagtgtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttc

SEQ ID NO: 77756 - DNA, 1286 bp, Homo sapiens
gcagacaggttgacctgcaaaaaaagacaggggaggcatggaaacaaaggacccatcgcaaatgttttccatgctgatctccaaagtgtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccac

SEQ ID NO: 77757 - DNA, 2414 bp, Homo sapiens
gcagacaggttgacctgcaaaaaaagacaggggaggcatggaaacaaaggacccatcgcaaatgttttccatgctgatctccaaagtgtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttc

SEQ ID NO: 77758 - DNA, 2141 bp, Homo sapiens
gcagacaggttgacctgcaaaaaaagacaggggaggcatggaaacaaaggacccatcgcaaatgttttccatgctgatctccaaagtgtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctgagtatgggctcctggtgggcggggccgcctcgcaccgctacgacctgggagggctggtgatggtgaaggataaccatgtggtggccgccggtggcgtggagaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttc

SEQ ID NO: 77759 - DNA, 179 bp, Homo sapiens
gcagacaggttgacctgcaaaaaaagacaggggaggcatggaaacaaaggacccatcgcaaatgttttccatgctgatctccaaagtggtgagtttatgtgtgatttttattttgtttatgctcttctgtattttccgaatttcatacaataaatatctgttacttttacaatatgaaa

SEQ ID NO: 77760 - DNA, 279 bp, Homo sapiens
gctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcag

SEQ ID NO: 77761 - DNA, 349 bp, Homo sapiens
ttgcagtgagccgagatcgtgtcattgcactctagtctgggcgacagagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatct

SEQ ID NO: 77762 - DNA, 2338 bp, Homo sapiens
ggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttc

SEQ ID NO: 77763 - DNA, 2025 bp, Homo sapiens
tagtcaggctgggtgttaatcggcaccgagggcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggcccgcctcgcaccgctacgacctgggagggctggtgatggtgaaggataaccatgtggtggccgccggtggcgtggagaaggcggtgcgggcggccagacaggcggctgacttcgctctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttc

SEQ ID NO: 77764 - DNA, 859 bp, Homo sapiens
gcagacaggttgacctgcaaaaaaagacaggggaggcatggaaacaaaggacccatcgcaaatgttttccatgctgatctccaaagtgtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagatccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccac

SEQ ID NO: 77765 - DNA, 1970 bp, Homo sapiens
caatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgt

SEQ ID NO: 77766 - DNA, 1698 bp, Homo sapiens
ggttgcacactgcaacaaggtgtcggatcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgt

SEQ ID NO: 77767 - DNA, 1729 bp, Homo sapiens
gagagagagagagagagagagagagagagagagagagagagagagagagagagagagagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgt

SEQ ID NO: 77768 - DNA, 3198 bp, Homo sapiens
gtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatgccttactttacattcctgactaccgattggctgagggattgtctaatagaatgcca

SEQ ID NO: 77769 - DNA, 305 bp, Homo sapiens
aacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtaagaccaacatatggatggaagattgttagataaccaatgaataattagaaaataaaaggacagctacaatgccaccaccaaacactcctatgtcttggggtactttcactcatgtgatttttacatatgcaagccacatatttactgtttgtatgttaaagtc

SEQ ID NO: 77770 - DNA, 5610 bp, Homo sapiens
gtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtacagatgaaggcacctatatgtgtattgctgagaatcgggttggaaaaatggaagcctctgctacactcaccgtccgagctcccccacagtttgtggttcggccaagagatcagattgttgctcaaggtcgaacagtgacatttccctgtgaaactaaaggaaacccacagccagctgttttttggcagaaagaaggcagccagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatgttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacggatttctgatactggcacttatacttgtgtggctacaagttcaagtggagagacttcctggagtgcagtgctggatgtgacagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaagatatcagcccaccagcacaaggagtggaccacaggcaagtgcagaaagagctaggagatgtccttgtccgtcttcataatccagttgtgctgactcccaccacggttcaggtcacatggacggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaagccccaagtgccccaccacagtctgtcactgtactgacagttggaagctacaatagcacaagtattagtgtttcctgggatcctcctcctccagatcaccagaatggaattatccaagaatacaagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcgggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctgttacgtttcaaagaggagatggaggactaatgagcaatggaagccgtccaggtcttctcaatgctggtgatcccagctatccatggcttgctgattcttggccagccacgagcttgccagtaaataatagcaacagtggcccaaatgagattggaaattttggccgtggagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatggctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaaggagatgcaacccatgctgcaggctcacctgggatgagttgacaagagcctattcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgt

SEQ ID NO: 77771 - DNA, 1267 bp, Homo sapiens
gtcaaaatgagtctgctgatgtttacacaactactgctctgtggatttttatatgttcgggttgatggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcattgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtatccgtggtggaaaactgatgatctccaataccaggaaaagtgatgcagggatgtatacttgtgttggtaccaatatggtgggagaaagggacagtgacccagcagagctgactgtctttgaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtatgacatcaaagacgattacacactaagaattaaaaagaccatgagtactgggatgagttgacaagagcctattcagtttgatatagcaaaacaaacatggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggtaacggaaccaatttaataggaaaaactgacctattggtaacattaaaatgcatcaaaagtcaactacttccttattgtaagatttattccactccatctatttctgtaacattttaaatgtgttaatattaaatacaaaattcaa

SEQ ID NO: 77772 - DNA, 319 bp, Homo sapiens
agaggagcaaagtcacaatgcacaggggagtgcagacagagacgggaacaatttgtgaccatactcagttattctggccaacagtatgtgggaaaactaaaggtttcaaatcaggagaacagaccaatccagatcaaaacacagttcaagattaggccagggcagagacctaggtagcaagttaaaaacaggtcagagacccagttactggaaatgcctgcgtccaagcacaagaaattcagtcacttaggagacacagtacaggcctacctagtttcagagatcactgctggtggtttattaactcctagtccattca

SEQ ID NO: 77773 - DNA, 621 bp, Homo sapiens
agacatgaaaggtgacccttctgaatccagtgtcagcagactagcatggctgtccagatcacaggatattacggatctttcaaacagaatgccaaactataaagatgtgtggaatatgagcacaatatatactatgtgagtaaagaagctacaggctgcgggtaataggagaactacttcaaagcagctatgggaaagctaaaaggggttagaagtaggagaaggttattagaacgtcattaggccatttcatggaagccaagagcagaaaggccacggatgtatggactggagccaggattggagcatgggggagcctgcatggattggtgactttttccacagagtgtgggttcgtgcctctttagctgtagatcagtactctgtccataggtctataggacagaaaaggatggccaagagctcctgaattttacatgttccagtccagggactaaagagatttctctttccaacccagtctacacaattgatgaggaagaaacaggagtttccccaggtcaggtgtgacccctgatcaatcaattgtggatgggcacagagtcggggaaggattttgattaaccgggctcgggtctcctctgcccgcagaagtgaata

SEQ ID NO: 77774 - DNA, 398 bp, Homo sapiens
atccatttagaaacccaccttgtgttgctaattatctccccatgagcaggtcctctctccaataaattgcatgttgtagtaaaaaaatgggctcatgtttctggagtatttttcgttgtgtgtagtgcaatacaggaactttaaagaacaccatgggacccatgtgaaatgccactagtgaagctggaagtgcgcccaagaacagagaaaagtcacgacatgacaagaaaaacttaaattgcttgatacatactagagattgaatggttgccctccacaccacacagataattcattgtgtcaacatgtagacttacagaatcgaatgcagtacagtcccataattgtattgtctcttatgattttcttaataacatttttttctctagcttccttat

SEQ ID NO: 77775 - DNA, 1424 bp, Homo sapiens
tggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtga

SEQ ID NO: 77776 - DNA, 1383 bp, Homo sapiens
tggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtga

SEQ ID NO: 77777 - DNA, 419 bp, Homo sapiens
ttagaaataaaaatatcagctctacctagacctaatgaaaatcagcattttaacatggacccccccaggggcttcctttgcacattaagtataagaagtgctgcccagcctagcacagggcctagcacagggtggtgtccagttagtgtagttttcttctttccaaattaaatgagttttaacccatgaacttgactacctttgccataaaaagaaacaaaaacaacccaacaataacaactataaccacaaaatacaagattgatgtattctctcatttgagcttatttttggtagtcctcccaaacagaaaatatatatacatatatatgggatttccttctctttgacattatttatgctgacctcttgaaacagaatgttaaaattgaattttgagcaagataccaagaaaaaat

SEQ ID NO: 77778 - DNA, 248 bp, Homo sapiens
caacacactgaaattaatcctaaaatagtacttaaggtttgttttaatttttttgtgtgtgggagaatattttcttttctcaaactcatctttagtgtggaaaaagcatagctctctttgtaacactgaaataatgagtcaaaacttcagaacttctgaccttcctggtagtgactgatttaatttacaaccgctctatcaaaacatttaattcagttctcctctctaaagctattttcagtcaacag

SEQ ID NO: 77779 - DNA, 453 bp, Homo sapiens
attgctgggacaatttgcctcgaaaacctgtatgattgcattacagaggagatactcagtgttccttttctcttctgttcagataccctgcagatttacccatctctgccttcctctctgagagtgcttatcttttcataaagcagaatcattacattcccgacgtgtcatcaaaagtgtctacaggctgggcatggtggctcacgtctgtaatcccaacactttgggaggccaaggcaggaggaatgcttgagctcgggaggtcaggactagcctgggcaacatagggagacactctgactctacaaaaaaaattttttttaattatctaggtctgctggtacattcctgtgttcccagctactcaggaggctgggataggaggatcacttgaaattgggaggtcaagtctgcagtgagctgtgatcatgccactgcactccagcctaggct

SEQ ID NO: 77780 - DNA, 650 bp, Homo sapiens
cacttttccaaatgctggtcctgatggatggaacaggctccccttttactttatttcataagtggtttataaccctgaggctgagaaacgatataaatgagggggaaagaagtatcctacaagaaatacccagttaaagaaaagaaaactggagaaaccaagcccccatttcttttttttttttctccaatgcctttttgaagcacctaaaggccaaggaattttgaaatgagaactcgacagtgaaatgtttctcattttcaaacaaagaaacatttcttactcttgggtgttttgtgtgcagaaacacttttttgatatgtcatatttaaaggtgagaatgatccacttggtcagtagatccgtggagcgtcaggaagatggaaagaggaaagggccccgaatgacccacctgcgtatcttttgcatatgtttccaaaaatacaagtctgttcatcatactcgatttttcctttgtttttattcacgttttagcattccttttctgcattaaaaaaatgtatgcagtcctgctgctgccttcaaactagctttgtgatttgaagcttcactttctcatctataaaattcattcagcagcacccactgtgccttctgtagcacttccatccacctgacagtatgtatct

SEQ ID NO: 77781 - DNA, 576 bp, Homo sapiens
gaaaaaaaaatccagctaatcacagcagcaatcattatgccaacttgccttctggctcacttacttgtagagtcactactccagtataatgtggcccttgtcacaagactcttttcattttctattctataaagtctaagacattgtgagatgataagtcttctattggagcttctttcctaagttcttcatactaagaaaactacagatgccagctggtctggagggcctagtaagaacctgactcataaagaaatgcagttgctgtttcttgatgatttcatgtcccttatcctaagcaatcgatgacctcaaattttccagcccctcactctccacaaatccccatgaaaacccttgcccagagccccttgacagaacagatttgaggcttgagaattcctcccatttcctcattgggtgacttgtgattattaaaccctttctctactgcaaccctgctgtcagtgtattggtctgttgctgtgcagtgggcatagaaaactggcagtcctgtaacaagcagttgtgcagctgagggtggaagtaggggtggtaggagaagagaagaatttt

SEQ ID NO: 77782 - DNA, 650 bp, Homo sapiens
aacagtgtttccccctacaatccacaagcataaacattaaggaacacagctttgaagggtgtttatatgggacagtgtttaacagaaagtcctattacaatattaactctaaatgcatctcacttctctcatatcaaccactccatgtttttctccctaggccttagctgaaaaatacttggctttctatctttcctctaagacctcttcccacttcaaaactgttatcgttgaattattaatttcagttcaaaagctctttgctttaaagttataagggtctaggttttcatgattctcatcaagagtcaaaatcttactggttctcatctttttaactttctattttttaatttctttttttctcttttggcaaacatgaggaagaaactgccagcagaaatacaggtggaagcacctcctactatagccttctcttgtatttttaaagcagctttgtcatatggttaatgaaggagaaagtcgacaacatgtgtagtgtgtatgtctgctgtcagcatattgcagtgtgtgaccatgtttgtttccagttatctgaagtatcttcccaatctgatatctcttcctttaaagaattttttgtcatttaaaaataatcatgtttattctatgatatgtataaaatgagg

SEQ ID NO: 77783 - DNA, 430 bp, Homo sapiens
tctctacaaaaaatacaaaaattagctgggcccggtggcatgtgccgtgtagtcctcatcctactagtgggaggatcgcttcagcccgggaggttgaggctgcagtgagctgtgattgtgccactgcactccagcccgggcaacagagcaagaccctgtctcaaaaatgtgtatgtgtgtatatatatatatttattttagtggttgccttagggtttgcaatatacattcacaactaatcaaaatccactttcaaataatgctgtgctgcttcacaggtagtgcaaataccttgtaaccaagtattcccagttcactcctcccactgcttataacattgctgtcatttatttcatttatccttaggctacagtcacccaatacacaaattttattttgaacaaattgttaatgtgttagagcaattaaa

SEQ ID NO: 77784 - DNA, 351 bp, Homo sapiens
cttttgacagaagtgttttgggtttgggataattttggattttggaatatctgcattatacttataagttgagcatcccaaatatgaaatgctgcagtgagcatttctttggagtgtcatgttggtgttcaaaaactgtttggattttggagcattttggattttcgattttcagatttgtgttcctcaatctctgtggtttaaggctgagagaatagatctaatcagcagtcagtagagctcattagtagaggagagaggagagttttcttttaagaaggctatggggtcttgtgaagagacgagatagcttgtatttaattcacctgacagtcattagctagtaaaaat

SEQ ID NO: 77785 - DNA, 754 bp, Homo sapiens
aaaatgcaacattacataaataagaaatagatggtagggggtgggggcaggacctaaaattaagccaccagtaaaagtagttctttaaaaaaaaaaagtgttttttatattgctgacctgggagacctgtgcacttctacagatgttggcaaattcagctgtaggccccactcatggacacctgatctgttatggttcatagtgcccataagatgtagacaaattactcaaggaatacacaattattcctgaccctaacattagaaagtctcccacagaagactttctaatatgatgaatatctcttcctatatgttaagttcacaaaagggccctcacccactgtagaccgaggcattgtgacaaagcatttctacaggccccagtacaatacaggccaattactagacagcagagcagtttatcatgttttccattttgccacaaagttcaaaaccaagttatctttgtcctcagagggagcacatggtttcctcttcctgatttcctgtttccatatatattttgctggctttcttgccattttgttataacccaccttgggtcctttcgtatacttgatcttaaccaaaaggtgtaggagcaatggtggatccctttttttttctttttttcttttttttttttttttcttaattttcaccacaccattcaagagagaaatgggtccttttttaaaagagaaggctataaataagtcaccagtccctactctcccatccatgaagcatct

SEQ ID NO: 77786 - DNA, 652 bp, Homo sapiens
tgggattacaggcgtgagccaccgcgcctggccagcttggtgaatttctacatgtacaaacaccagtgaggtcaccgctcacattgaggcttagattattgtagcacccacaaggctccctgtggcgccttctaattcataaccttcccattgtggggaactaatcacagtttatttacgtactcccctattgctaggcacttacattgcttccaatctttcactcttacaaatagtgcttcagtgaacttccttgtacatacacatttgtctacatctgattgcctccttcagataaacttttagaagttgtgaatttcagtacgctcatatccacagggtcagagggtatgagcttattgaaatgctcccagttggccgggcatggtggctcacgcctgtaatcccagcactttgggaggctgaggcgggtggatcacctgaagtcaggagttccagagcagcctgaccaacatgacgaaaccgcatctctactaaaaatacaaaaattagctgggcatggtggcatgcaactgtaattccagctactcaggaggctgaggcacgagaatcacttgaacccaagaggtagaggtgagcccagatggcaccatttcactccagcctgggcaacaaagcgagactctgcctc

SEQ ID NO: 77787 - DNA, 564 bp, Homo sapiens
attcggcacagccatccagtcccataggatcttatgcccttctccaagggcataagatcctatgggactggagaaggggtgagggctgtcttaaaacccagccttcccttttctttttttttttcttgagacggactcttgctctgtcacctgggctgcagtgcagtggcgtgatcttggctcactgcaacctctgcctcctgggttcaagtgattctcctgccccagcctccctaagagctgggattaaaagcgtgcgccccaatgctccgctaatttttgtatttttggtggagatggggtttcaccatgttggccaggctagacttgaactcctgacctcaggtgatctgcccacctcggcctcctaaagtgctgggattacaggcatgagcaaccacacctgtccccttttcttttttcaaagaagagttttcatgaccatttgcttttcttccaactgaccaatatgttaaacttagcaacaagtttatcttggagatccatatttccagttgattaatgagtagaagttaactgaagatttgcagcttaaaaaaaaaa

SEQ ID NO: 77788 - DNA, 708 bp, Homo sapiens
  misc_feature (231)..(231): n is a, c, g, or t
agcggctgaagcaggagaatcgcttgaacccgggaaagggagattgcagtaaaccaagatcgtaccaccacactccagcttggatgacagagcgagactctgtctcaaaaaaaaaaaaaaattcattgtgacaattggtattgatcccaccttatatgagcgtacttagaaatagttaaatttcaccagaagaccagaaagtagaaccaggtggttatcagaaggccaagngggttggaggagcctgctcagcggcgagttattggcttcaagaagtcacagaagttctcagtttggggaatgataacaaaattctgggagctgggttggggaagtgcatgtattggcacaacagtgtgcaatgtcacttaatggccactggaactttacaccttaaaatggttaaaccagtaaaatttatgtcaaatatattttacccataattaaccatttttaaaaattggatgggaaatattatttggcaatgggaatagttgcaagtggttggttaattggttcaaaccaccttggtactggctcattgggttgagggagattagagggaagaaatttgcaaaagatgtttggctagtgtgtactacaagatttcagatgacttgttgcctggtatagtagctgcacttctttaaactttgctatactgtatatacagccaggaatgtttttctcaaggacatggcagctacc

SEQ ID NO: 77789 - DNA, 95 bp, Homo sapiens
ccttagttaacatttactggtgctcacctaggattggctattctgagggattgcatagaaaccaagctccacttgctgtccttgggaaggttata

SEQ ID NO: 77790 - DNA, 443 bp, Homo sapiens
tataaaagaaaactttctttgggaggagattgggtatcacttcgtttcttatacttcttaccctgcattatacaataatgacttcaaatatatgtatagtcttatctgtgggaaagttagatcttcatttatatagggtattgagttgcatccatgtatgtggtgaaaacaaagcttatatctaataaatagagaactgattgtcattcataagggccaaactttcttactttgaagtgatgtatctgaagtaaataatatgccctaatagaatctgatgtggtagaataagttgaatatattatcaaaagtaattagaatagaacagcactgtccattagaaatataaatgggagccacatgtgtgattttaaattttctagtagacacagtaaatgagtaaaaagcagatgacattagtattagtaatacattttatttaa

SEQ ID NO: 77791 - DNA, 353 bp, Homo sapiens
gcaggagaatggtgtgaacccgggaggcggagcttgcagtgaggcaaggtcacgccactgcactccagcctgggcgacagagcgagactctgtctcagaaaaaaaaaaaaaaaatcccagcacttcgggagtctgtaatcccagcactttgggaggccaagagtttgagaccagcatagccaacatggtgaaaccccgtctctactaaaaatacaaaaattgggcacggtggctcacacctataatcccagcaattttcgaggccaaggcgggtggatcacctgaggtcaggagttccagaccagcctggacaacatggtgaaaccccatctctacaaaaaatacaaaaatta

SEQ ID NO: 77792 - DNA, 294 bp, Homo sapiens
tggtgggattacaggcgtgagccacggtgcccagcccaccatgcccattcctaacaagtgccctccatctagagagagaggcaaggcccaaaatgtggaaatacaagggcagtctgtttggcaccccttgccaggatttatggtcttctgagcccctctcctaagggtcacaatgacctctgctcatgaaggagtcgtctcagtggttccatgaaggtccttagcctttaatgagcagttcggcaccctccatcaaagagcatgtggtccagttccaccaagatccctgttccc

SEQ ID NO: 77793 - DNA, 178 bp, Homo sapiens
gtaaggcgaggggcacagcctgagtctccaaacagctgccagcaaggctccaaagcagccacaatagcagctagtctgcagggcctcagcctgccaggaggagacctgcacccattcaaaagcgtacttctctgtgttgggttgtgactccacaaacacagtttgcagctttcagaat

SEQ ID NO: 77794 - DNA, 346 bp, Homo sapiens
tttgatggtgaggaacatatctgtcttcttcatggttgtttttccccagtgcctggcacatagaagacatttgataatattcattgactgaatgaatatgatgttcaatgtattaatcatttcccatttctactttgcatattctgtcttaaataatgattgtattttctgtagagtctcactttggatattagatgtgtactaggattaagtaaaaataactgaacaatgttctaaaaattctgagatttctatcggagaaatatttacatctgcaaaatttttcctagaaaataagttcccagaaatgatacatttttgatgtccaataaataaattattcatt

SEQ ID NO: 77795 - DNA, 345 bp, Homo sapiens
tcttttctaaatgtttggtagaattcaccagtaaagtcatccatttctgggctttttttgatagaagatttttgataactgattagattgccttacttgtatttgtctgtttagattttctatttcataattcaatcttgataggttgtatgcttctaggaatttattgatttcttctagattatccaatttgtttggatataattgttcatagtagcctcttagaatcctttgtgttttgtaatatcacctgttatatcctttttcatttctcattttatttgagtcttttctcctttttccttcgtctcactgaaggtttgttaactttatcttttcaaaaaa

SEQ ID NO: 77796 - DNA, 311 bp, Homo sapiens
gaagaagaaaatacaaatcaccagtaatcccacaacccagcagcaactgctattaatatttaaactatttcctttcagggttttttggagggagaggcagccatactcttgtatcgtgtttatgaacttaatattatgagcattttcccatgtacatagctattcttcaaaaacatggtttttattggttgttttggtgcccaaatatttttctttagtttcagtgttatttaaaacagcattcataatcccagcactttgggaggccaagggaggtggatcatttgagctcaggagtttgagaccagagc

SEQ ID NO: 77797 - DNA, 730 bp, Homo sapiens
cacctgggttgagagggagcagcagtgctatggatcttcctcagaagaacatgaagttgcttctgtggaactggttatctgccatggcctcaacaatccataatccagtcatggagaggattccccatggtcagaagtcaacttgcacatctagttaaagtccaaggtaactgcaaacagtggaacatggcttaggttttgaagcctcgttattggatatagtctttatcctaagttctgaggagccataaaaatagttttccagaatggatttttttttttagataaaaagattatctaccttttgggggtggaatatcttattttgtttttgaatttgtctttgttataaagaagagtaaaacaaagatgtgtaagtgtgagtctgtgtgagctagtttctgatgtctaaacagcaattacctatggagaatacatcattcaaagtaatagcttttgttcaaacatttttaggaagtaataatacatttcttcctggacagttgataaaagttccatccatagcatatttccagaatatccctagatgatgaatttaaacatgccttctcagaaattaaatcttttgactttgaaccacaagttagcatttatttgttgaagagaagaatgtgtggtgatgtcttacctgaatgttggttgttactgatatattacaattttcaaggtgataagcttgagctattaaataataaaaagtattaaagta

SEQ ID NO: 77798 - DNA, 1482 bp, Homo sapiens
tctgctggactttgttgaacccaggggtgccaagtagcagctggctatgctcagagtctgaaggttgtccagtgatttgaagcagaaggacaaacactctcccctgaacacctggctccaggccttctgcacctcagccctgtccttccagcatcaatcctttcaaacataaggtacttcagtcttgttaagaggcatgttgggggtttcagagcctactggggcaggaaaggggagggtagtggtggtggtagaatcagacccactgaaatgttagatgggtagatatgccctgccagtccctggcggttccatcccctccgaggcccaggcacatgagtgaagaggccaacgtgtgtatccagcccaagtgagccttcagatgattctagccccaactggtgtcttagagcaactgcatgagaccccaggcgagaaccaccttgttgaaccaggcagcccagagaactgtaaaagataattgttttaagccatgtattgtgtgtgtgagagagacagaaagagagtgaatgttagttttatgaccattagataaagactttcaactttaatatggtggaaagtatcctgggttacaaatgctagaaatgtgcacctgcctgcttagtaatatcccatgtatagctcaacgaatattgagcacctagcagggtccttttccgtggatgaagggctactaaaatatttcatgtccttgttttcatggggaacttgatgcaggacagctcattaataatccagctacctctgtgccccaaaaccattcaaaccttgtcagaaaatagaggaaaccaaaaatagaaaagcattaaccaagaaacaaaaaggcacagcaactcttaacagtatcagggcttagccattccattgagggctgaggtttttataactaattaggctaaaaaaaagatttaagaccagaaattgctaaagccataaaagccagtccaatgtgaagccagatctgtcgttcaccaagagaaggacaagccagggctgaggggattccggcaggcgctgtggcccattcacagcttgaatgtaaacattatgttgtgtgtctggcatgagactgtgaagaaaacagccaacaccacacacacatcagctttatgactctggaaaaatcaggaagcacatttagaaacataaagtatttccagggttggtcagagaacctgctgtgccatcactcctttgtctttgctgctgtgattaaaaaatgttgacaagcgtcagtgggttgcccttatcgcaaatgttagtacaaggtcaagtgagactctattaagacatttcctccatccagccattcagttacaggccgcgggaacgtcctctttacaagaccagaggagctctgaaaagatccaccaaagtttatttcatcagtcctgaaacaaatttgatctttcagaaatattagtaaaaaaaaataaataatggccggaaacctgaaaa

SEQ ID NO: 77799 - DNA, 828 bp, Homo sapiens
atgcatttcttaaagggatttagtgcagttattttaaataatttatgcacgcacacacacatacatatatcccccgagtacatattttttccctttttacttgtgtgcaatcagtagctacaatgactgaaatccacttctttggactgtgacatttaagcaaatcttgtatctagaaaccgaaatgcccagagtctcgcacaagctgttcgtctgggccaccaactcacacagccgccgcccagcgcctcggcacgcgtgctcatcttgtgtaaaagtaaaagttgctcatgtcattagctcggctctgagtttgcatgagaaaccagcgcagctctcgagccacgggagaaaacacgatctgctgcggagcccagtgacctgaaactgtagcagtgactcgagacctgtcctctcctcgacgtcgccctataaccctcccgctttatttaggatccgcttttccgagagcagccactcaggcaacccccggaaggtttgttaggagtttctccttgaaacgctttccgattccatcttttgaaatccagcaggcgagagtcacgacagactccaggacctcttgagcgctgtccgcagccccacggtaggagtagccctagtgcacgagacttggcggtggctgaaaagctcgcccaaacgcacgcaccacctctctgcggggttgcggattgcgggttgcggtctttgtccgctcgcccttcctccggggccgcacactcccgcatctggccggcaggtggcgcggttggctcacgatgagctgcggccggggctggagaggctcctccacctcccagcggccgc

SEQ ID NO: 77800 - DNA, 478 bp, Homo sapiens
caacccaaaacagactaatgtacaagaaatttgcaaagcccctctccctctatgccagacacttgcctaataatgttcaggaattatatgtaatgtatacaagctgcagtaaaaacaaaaaaaatctatatgggactctttaactgcaaagaccttgagatgacacatctttttcaatgtattttgattttactacaacaactagctcagagggagctttatagggagcaatattactcattaactctttgttgaatgaattaatgaactagtgagtggattaataaaattaggccagttaagggaacacactgtttctacgccagttggctattttgggtttaaatatttttaaaattactgttggttctgctctttttttttgaaacaaggtcttgctctgtcacccaggctgcagtgagccatgatcatgccactgcactctagtctgggtaacagagcaagatcctatcttgga

SEQ ID NO: 77801 - DNA, 669 bp, Homo sapiens
aggcgtgagccaccgcgcccggcctcggtaaaatgttttataaaggcagtttctgccctctccccgcgtcccccacccccctccacggacctacttacccagcctctgagccgcagtgccctcctctgtaaagtgggtatatcagagcgccaagtgcctggattacaggaaagggctgcgtttagctgcgcacccggccacggctgggacaaacacgcgcagtgacacgcggcggctgcggttcccgcgctggccgcggtcgggctctggcgctcctgagcccgcgctcggcccgcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcacgctgcacgcagagccctacctcttgttctccaccgacaagaagttgctgttgtgcatccgctgcttccgcgacatgcagaaggagagccgggcacactgcgtggacctggaatcggcttacgtgcagggctgcgagcggctggagcaggcggtgctggtgagcgcaggggcctggcgcgcggggccgcgcggcggcgatcgcgagcctgaccacgccctgtcccc

SEQ ID NO: 77802 - DNA, 222 bp, Homo sapiens
tgaggctccaccctgatgacctcatcgcatcccaaaggccccaccactaacccatcgccttgggggtgaagatttcaacactggaatttcagattcagaccccagcactgagtgcatgagtgcacgcttctgtgtgtgcacaagcatgagtgcaagtgcatgtctgtgtccacgtgtgtgtgcatgtgaatacctgtgtgtgcaggtgtgtatgcaagtgtg

SEQ ID NO: 77803 - DNA, 150 bp, Homo sapiens
tagatttcaggaaaagcattaattttaaaacagataccagtgtgtaagttttaagcaggctaaaatttgactgtatgttaatagttgaaggccagactttcagtaaaacagatctttatctctaaaaacttttttatcctttcatcattg

SEQ ID NO: 77804 - DNA, 218 bp, Homo sapiens
acctacatcctctattcattatttctaaatggggaactactgttatttgaggtagggtaattatttgtgctacactcttggcagcttccaagatggtttgcattcctggcctttggattctaaatgccagtaacacctcagtcatactgacaaacaaaatgcctctgtacatttccaaatgtgagcagctgtcagcagggggcttaagctaggtgcag

SEQ ID NO: 77805 - DNA, 893 bp, Homo sapiens
ggagagtgatcatcttttttcgtttaattaagatgtgttgctgtctcttctcagccatacatggtattgagttttagattagaatgggaaagcctagtattctggctagataatttttggttatattacacattttctgaacatcttcagatacttcagcatacgaggataaaaaccacgtagcaaagccaaatgaaaattattttttgttttatttacactggagtgtttcataattcatgtggataattgttagggcaatgaaaaatcacttttggaatactaaccgataatcatgtgattgactagaggccgaagtgtgctatgttccatgtagataatttttggaaataatggcttcattaagatacaattcacatattatatagttcattcatttaaattgtacaatttggtgctttttaaaatattcatgtagttatgcaaacatcaccacaattttagaacatttttatcatcccaaaaaggaaacactcatacccattagcagtcattccctaacgccccaggcctaggcaaccactaatccactttctccatttagatcatattttttaaataattattttccaaattataatttagagcaaatttggaaattttctgcttattatagtgtgactattcaaaaactagtgcttttcttgcatagtaatgtattgattttcaggttaacacctttgttatttttcaggttcttacttagcactagaagaaattaattcttaaacggcatcttattgttattgtagggatgagcgaagagcctctctgtttactcaattttaggaacactctttttggaatttaattcattcctaaggcagagaagacagggaacagtatactaaacctaaaaaataagcaaaaat

SEQ ID NO: 77806 - DNA, 487 bp, Homo sapiens
cagagtctcactctgtcacttaggttggagtgcagtggtccgatgttggctcattgcagcctttgcctcccgggttcaagtgattctcatgcctcagcctccagagtagctgggattacaggtgtgcaccaccacactcagctaattttcatgaggttggtcaggctggtctcaaactcctgatctcaagtgatccgcccacctcggcctcccaaagtgttaggattacaggcacgtgagcctccgcacccggccaattttttgtatctttagtagagacagggtttcgccatgttgcccagggcagtctcaaactcctgagctcaagcaatccgcccgcctcagcctctcaaagtgctgggattacaggtgagccactgcgcccagccaaatgcattgtcaacttacagtatttccaacttacgatgagtttattggtacataaccctgtcataagtcaagaagcatctgtattgtcataattgtt

SEQ ID NO: 77807 - DNA, 498 bp, Homo sapiens
gtagttaggctaagattggaaaaatgattagaagttggccaaccagggtggagtatgggggtagggaggtagtgtttaggtggaggaatatcacatgcagaggttgagtggtgagaaagttcttgaggatggtaaggagctccacattttcatggatgccacagctcacaggtgattcatcttgaacatacagccaataaacacccaaagactttcccatcttgtaccaaggcaggtggatttttttttttttcaagactgaatctctgttgccaggctggagtggagtggcacgatctctgctcactgcaatctctacctcccaggttcaagcgtttctcccaaggcaagtggattttgaaatcaagaaaatggggttcatgagagaaattcttggcccctgttgctgtcaggaaggcttttagactaaaaagaatggagctaatgaaagcagttggatagggcaagcgtgtgagcattggctttcactggcttagg

SEQ ID NO: 77808 - DNA, 664 bp, Homo sapiens
tgatacatcctatatataaattttagcatcatttttcaatatttttaaaatgcaatgaagatctcaatggcaggtgaaaaatgatatctgcaagtgattttttaaatgggagcttattcaattttgtaattatagctgtatgtgaagaacaaacaaaatacatgtgcaaaatataataacagcaatatctgcctggtatttctaaaggactttggttacatataattcttgtacgcatgataagaaaaggaatgttaatttttaactcaacaaatacagcgttcctataaggtggtctgtacagtatattggtttgtataattcacacattaagtgaaaggaaagaaagagatgaggagtggaaacacttatctcatactcttgtctagttgaatattgttttttccatctttgacatttgaattttgtagtacagtgcagtatgaggtgtttaaagcctataaactgttatttaactaatactgttttctaaaatactttccatgatctaagaaaataatttctagtttcttgggctatgtattaactgggcattctaaaacgtcacttctcatcactcccatgatagtacaatttcctgcttccctcctaaatcgctagtgctccaccagtctcctttgccagctcccttcctttgcctgct

SEQ ID NO: 77809 - DNA, 658 bp, Homo sapiens
aggctgaggcagaaggatcacttggaaaaaaaaaagtagaaagaatgtaacatcctaaatatatatatatttggtttcggcccccagttcttgacacagtttttattttgtttgttttttgagacaggatcttgctctgttgcccagactggagtgcagtggtgcaatcacggctcactgcagtcttgacctccagggctcaagcgatcctcctgcctcagcctctggaatagctgggatcacaggtgcatgccaccatgcccagccctgacactgagctcctaagtcccttgaatttcctaagttacaggggtgctagcagcatgttttgttctaacatttggttttgatcccagtccctggcacagagctcctaagtccgttggaatttcccgggtgacaggagtgtcttttgttctaatgaggtaactcctgggtgggctgatcaccagagagatcaagctgcaatgaggagcttggaactttcagccccaccaccccccagcttcctccagagactggagaggagctggagattgagttaagaatcgatgacgcctatgtgatgaggcctccgtcaacatcccgatagggtttggagagcttccaggctgctgaatgcattcccgtgcgcagggggtagcgtaccccaactcca

SEQ ID NO: 77810 - DNA, 799 bp, Homo sapiens
tacgtgttccagtaaataccccattttcccccaagcaaattagaattggctttctctgtcacttgcaaccaagagagtcttgactagtataagcctctagcataggacctcacacattagttcctgtaaaatagcaactatcatcaccgttattcatatgataaatgagcaagccatcctctttggtaactgtaaactgtagaaatgaaaagtgcatgcagtatgctcaataacttttgtctcccctcttattcccagcctgctcctttgtcctttccaaattcacatcttgacctccaaggaaaccctcaacattcattaaaagcagagcccacccatcttataaaaatagtcccagactcacccaagtcacgaatattccgctaggcagcatttgctcccatgttacacaagtgatcccttcctagactataagcaactgggagcaggtgtccagcttcaattcactttcaagcctttgagcaaaaattgtacaaatatttgcacagcctcctttgtcccgtactgtagacttaaagaaacaatgagctactgcctctacacttaaagggactttaccatggggaaagacaaatagtctaggacagagactgagatgacagatgacaataccagggagtcctctaggggatggaggtggagtggttatttgcaccatgttctaagttccaaaggcctgtgctgcctgcagtcttgacttatgacagattttatacatccacactaaacctttcttctgtgcccatcacagtatccagagaataaatttcatttcaaa

SEQ ID NO: 77811 - DNA, 431 bp, Homo sapiens
tcactaacatgaccaaaccatatcaatttattcaatttttgcaatatttgtattattaatgctttgtattattaatgcttttttggaattatttgtattattaatatacttattaatatttgtattaatgattttaatatgtaatatattatatattccttttatagaaatatgtcagaatatttatttagaaatttatatatatttattatttagaaacatttaacatttaaaaataagtaatgtcctaaataaacaatgtaatgttctaaataaacatttcttagaaatatatttgtatgcgtatgcccatatgtgcacgtgtgtgtgtgtatgccagctgtaaaaagaaaattctctactttgtatttttgataattagaattatagtggtggtgatttgctttgatataaaacatttgacaaacatc

SEQ ID NO: 77812 - DNA, 415 bp, Homo sapiens
gccacacactggagagggagagctagagagtgagacagcaggggagctgagggtgaatggctgctgttagaagccctggagacagcctgaggtcagagcccagccccactcctggctgtgtgatcttgagcagggctgttaacttcactaggacttggtttcggtttctcatagagaataggtacagtgtgaattaaatatatatagcttgaataaagtgcccagcttgtgggtagctgctgccatcatcatcaccatcaccatcatcaccatcaccatcatcatcatcatcatcatcatcatcatcatcatcatcatcatctcaggcacaggggctttaaggacaacatgcccagtttaagaagaacacaactctcttcatttatagcgcccctccatcagtgagtagacgctt

SEQ ID NO: 77813 - DNA, 344 bp, Homo sapiens
ttaatggtttatagagtattttatggcattcacctaaatctctttccattttgcccaagatcctggcgagggaaacaaggtagaaattttacagattttactcctccggagagagccttttccttataactacgactctagttaggacattttttgttgcaagaaatttgcgatttatcctaaggaaaatgggatatagtataaggatacctagggtaagaaacttcaaaccccttagagacccagctactgctccgattgctcaaggtttcgtgctctgcgctcaagggctgcgttttggtgtctttgttctgcccaattttcttattgtctaattttccttt

SEQ ID NO: 77814 - DNA, 1012 bp, Homo sapiens
aattatacttttgtgaatatatcacggagtcattaggcattcagcttcatcacagcaggtcaggggtctcactgatggcatacaatatagtgatcgggtactctgacttggtagcacagtaagacagacttgccttaaacttatgagtaaggaaaataacgattcggggtgacgcccgaatcctcactgctaatgtgagacgaatttttgagcgggtaaaggtcgccctcaaggtgacccgcctactttgcgggatgcctgggagttgcgatctgcccgaccttattcacgcctaaaaagtagactgactgtggggtggtcgtgttttttgtttcttgttggtaggtggtgaatgcgtttttttcgttgttttctccgttactcaggctgccagttgcttggcagtcttgtcgctggctgtggacgctctgcacttcatcaccgtccccagctgcgctttgagccggtctaaggttgcccacagtattgacgttgggacccacgaaactggcaatttccatgtgtgcggccttacccagttctcccaaacttctgcgtataaccgcttctctgtgcttcagaaagataagtccggccccggcctcacacagcagctcagttcgtgacagcgtttaatatgtaaaatggagcaaataatttatagggcgttgggagagttaaagagactaattcatttacgtgttaaatacagggaatggcttttgcattgatataaccccagcctccagcatgcgccagacctgacgtaggtgttcggcacatattttgtccaatcactctaaaaatacactccatgcccttagaacaggtggggttatgtcctcttggccatcaggcatcaggagctccgtgcagaaactgggtaagaggccaggagcggtggctcatgtctgtaatctcagcactttgggaggctgaggcgggtggatcacctgaagtcaggaggtcgagaccagcctggccaacacggagaaaccccgtctctactgaa

SEQ ID NO: 77815 - DNA, 295 bp, Homo sapiens
caaacaccgcaatctcaggccccacccagacctactgactcagactccgaattaaaactccagatgactcatgtgcatgctgatttcaagaagcatgtaatcttcaaacccttttgctcacattaaaagaattttgcaaattatgtaccccttgcatgtttttatgctgctatctaaaactttccccaaatgtttagttgcaaaagaatgccattccagtgtgttgtaaacatggatcttttttaaaaagtcttatttcagattgcgtgtttggggatcctcagagtcaccccag

SEQ ID NO: 77816 - DNA, 390 bp, Homo sapiens
caaacaccgcaatctcaggccccacccagacctactgactcagactccgaattaaaactccagatgactcatgtgcatgctgatttcaagaagcatgtaatcttcaaacccttttgctcacattaaaagaattttgcaaattatgtaccccttgcatgtttttatgctgctatctaaaactttccccaaatgtttagttgcaaaagaatgccattccagtgtgttgtaaacatggatcttttttaaaaagtcttatttcactttttaaccattcccttcatgattcattttatttttttttttatgtatttatttgtttattttttgagacaagagtctccctctgtctcctaggctggagtgcagtggcgccatctcggctcactgcaa

SEQ ID NO: 77817 - DNA, 955 bp, Homo sapiens
taaagctaatgggaggccatcaggctgggggcaaggaggagagcccggatcctgctaaggtgcagacataaacgagtatcagccattattctggaggttataagatatgcaccttccccaattacccctgcaatcacaccattattgtagattggcccttagagtatcttttcaggttttttggcatgtctgacactcatggctctacttggacccaccaaccctgctcctatggctccacccagaagccattcagcctagaggacagctctgaccccccctgtgatttcatacaatcagcagcaagtaactgttacctcaccatccccaccccttctgccagactgcctttgaaaaacctctaacctgtgagcacgagatgattccagaacaaactctgtctcccatgtggcatgaccagccttgggtctcttaaactttttctccactataatgccatggtctttatgcagcaggcaggaagaattcaggtggttataattccgtatgtgctttttgaacatttttctactgggctattgctctcttcataatgatttttttaacttctctctataaggaactgatttcatctgaaattgaagagacaatcagagaaaaactatagaccactcatgatggttgttatatgtgcttggctgggccatgggtcccagtgtttggtgaaacacagcagcagatgtccctcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77818 - DNA, 1145 bp, Homo sapiens
tcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaagtcttgccgtttatttatgacagaaagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgagtctgcagatgtggatcctgactcctgagagaagtagctcaccgtgacgaagctgcgtttgcttttatcgatttgcaaatcaaagaagggggacatattgggagaaggccccccaaaatctggccataaactggccacaaaactggccataaaatctctgcagcactgtgacatgctcatgatggccataacgcccacgctggaaggttttgggtttaccggaatgaaggcaaggaacacctggcctgcccagggcagaaaaccacttaaaggcattcttaaaccacaaacagtagcatgagcgatctgtgccttaagggcatgttcctgctgcagataactagccagacccacccctttatttcaggccatcccttcatttcccataagggatacttttagttaattgaatatctatagaaacaatgctaatgactggtttgctgttaataaataagtgggtaaatctctgttcggggctctcagctctgaaggctgtgagacccctgatt

SEQ ID NO: 77819 - DNA, 347 bp, Homo sapiens
catgtaactttttttattcttgaaatttgtgaatactatagagatgtatttgaacaagaatactttgttttataggaccatttacctcttgctgtggtgggtagtaatactatcattgaagttaatggcaaaagggtcataggaaggcagtatccttggagtgttgctgaaggtaaggttttcttcagtgaatgagtttctataagatctcaaaactgattaaaaatttgtatttatagtaaggagtataatatgcacactgtattgatataatctagatttcaaggatagtactgatttcaggttcttgtagtctcattttcctcttaaatacattcatatttttc

SEQ ID NO: 77820 - DNA, 1491 bp, Homo sapiens
atttaccggaatttcggaggcttcgggtacccccgttaccaagtttgcgcaaggactttatttgtgtatgaatgaaaaagagggaaataacctttactgaactaaagacatgcctggataaattacacacagttaaaggagagaaaattagggaatgtgatatttttgctaacaggttgggccttatttataatgtagtgtcaaggaaactcctagcgtcgcaacattgggcagggtaatgacaaaacatcccagcagacatatctactatcttgaaacccttctagatgtcgagttatacatttagtttctattagtcaaaaagaccttggagacatttccttcattaggtggcaagaaagaaaagatggagaaaaggataaacttaatataagaatccacagagcagtagtttgatagatatctgagaatagtaggaaaaaaattgggtaatcccaaaataaatcagtgatttcagtatgaagttttctcaacataaatctgctataattaaaaattacaggccttcaggaagtgtcgagtctgggacgcccagcgcgggcccgagcagggggaagggaagcgcagctcggtccgcgtgggtggaggggacgtgaagccgccctgagatgatggttgaggaagggctctacggctcccaagctaggccaaatgcctccggcggccgcgcccgggcgccccttcccctgtggggcaaccctagcttgggacgcgtgaaccacctccgtagctgccccaccagcacccccagccgtgcgcccctgcaccatgcagctgccctgcgcatggagccgcgagggacagcaggcccagccctcagcaccacctgcctgccaggaggttcgggaaactggcgccgcagcggagagggcatctgtccaacgcctcccccggggctcagctgcgggcccccaggcataggcacccatgacccttctgtgttgtttgtctttgtatagtctgcagatgtggatcctgactcctgagagaagtagctcaccgtgacgaagctgcgtttgcttttatcgatttgcaaatcaaagaagggggacatattgggagaaggccccccaaaatctggccataaactggccacaaaactggccataaaatctctgcagcactgtgacatgctcatgatggccataacgcccacgctggaaggttttgggtttaccggaatgaaggcaaggaacacctggcctgcccagggcagaaaaccacttaaaggcattcttaaaccacaaacagtagcatgagcgatctgtgccttaagggcatgttcctgctgcagataactagccagacccacccctttatttcaggccatcccttcatttcccataagggatacttttagttaattgaatatctatagaaacaatgctaatgactggtttgctgttaataaataagtgggtaaatctctgttcggggctctcagctctgaaggctgtgagacccctgatt

SEQ ID NO: 77821 - DNA, 2010 bp, Homo sapiens
tcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaaatttgaggactacctaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaactacctggcattgccttttgttgagacttaaaccattggatattgagtttacaaagcatttgcatgaaaaagtgaatatcatcccacttattgccaaagcagacacactcatgccagaggaatgccaacagtttaaaaaacagataaagaaatccaagaacataaagttaaaatatatgaatttccagaaacagatgatgaagaagaaaaaaaacttgttaaaaagataaaggaccatttacctcttgctgtggtgggtagtaatactatcattgaagttaatggcaaaagggtcataggaaggcagtatccttggagtgttgctgaagttgaaaatggtgaacattgtgattttacagttttaagaaatatgttgataagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggaactgatttcatctgaaattgaagagacaatcagagaaaaactatagaccactcatgatggttgttatatgtgcttggctgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcatgtaagccaattccttaaaataaattctctgtcctgtttttgccccctctctctttctgacagcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77822 - DNA, 1681 bp, Homo sapiens
tcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaaatttgaggactacctaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaactacctggcattgccttttgttgagacttaaaccattggatattgagtttacaaagcatttgcatgaaaaagtgaatatcatcccacttattgccaaagcagacacactcatgccagaggaatgccaacagtttaaaaaacagataaagaaatccaagaacataaagttaaaatatatgaatttccagaaacagatgatgaagaagaaaaaaaacttgttaaaaagataaaggaccatttacctcttgctgtggtgggtagtaatactatcattgaagttaatggcaaaagggtcataggaaggcagtatccttggagtgttgctgaagttgaaaatggtgaacattgtgattttacagttttaagaaatatgttgataagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggaactgatttcatctgaaattgaagagacaatcagagaaaaactatagaccactcatgatggttgttatatgtgcttggctgggccatgggtcccagtgtttggtgaaacacagcagcagatgtccctcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77823 - DNA, 2130 bp, Homo sapiens
tcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaaatttgaggactacctaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaactacctggcattgccttttgttgagacttaaaccattggatattgagtttacaaagcatttgcatgaaaaagtgaatatcatcccacttattgccaaagcagacacactcatgccagaggaatgccaacagtttaaaaaacagataaagaaatccaagaacataaagttaaaatatatgaatttccagaaacagatgatgaagaagaaaaaaaacttgttaaaaagataaaggaccatttacctcttgctgtggtgggtagtaatactatcattgaagttaatggcaaaagggtcataggaaggcagtatccttggagtgttgctgaagttgaaaatggtgaacattgtgattttacagttttaagaaatatgttgataagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggtactagcaattccaaattatccagagcccttctaagttgtaagatctgaaagaaatgtctgccatctatattctcagccacacttagtttcttaatctgcaagatggaattaataatagtacttactttatgatgctgttgcagaaattcactgagttgctacacgccaaacactgagaacccagctgggcatataataagcattctattgcatggcattattgcatcatttttacttctattactgctactgcttgtaactgcttgtaactgtttgtgcttttttgatatgaaagtccaccatcagggagcactgtagtggaaaaggtattaggccaggcatagcctttagttctctggccttgggtccttcatctgtgatattcagttaacaatacctagccagtaggggtgttaaagattaaataaatgtgagaatgtgcctgttgcttaatcttcctcaaagggttatggactctcagagccagaagaaggtcatctctcctttgctcctcgtatgctgggatctgccacatcaatggcaacagctgggcctccagaatttgctccagggtgtttggaagtcctgacaccctcctgatcttctctgtaacatgcacactttggcctgtgtcagtttgctggaaccacatcaggccggccctcttcctgggacaaaattctttctttttctttctttctttttctttctctttctttctttttctttctctttctttctcttttcccttccttccttccttccttccttccttccttccttccttccttcccttttcttttcttttctttctactgtgac

SEQ ID NO: 77824 - DNA, 1913 bp, Homo sapiens
tcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaaatttgaggactacctaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaactacctggcattgccttttgttgagacttaaaccattggatattgagtttacaaagcatttgcatgaaaaagtgaatatcatcccacttattgccaaagcagacacactcatgccagaggaatgccaacagtttaaaaaacagataaagaaatccaagaacataaagttaaaatatatgaatttccagaaacagatgatgaagaagaaaaaaaacttgttaaaaagataaaggaccatttacctcttgctgtggtgggtagtaatactatcattgaagttaatggcaaaagggtcataggaaggcagtatccttggagtgttgctgaagttgaaaatggtgaacattgtgattttacagttttaagaaatatgttgataagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggaactgatttcatctgaaattgaagagacaatcagagaaaaactatagaccactcatgatggttgttatatgtgcttggctgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcataaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77825 - DNA, 1764 bp, Homo sapiens
tcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaaatttgaggactacctaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaactacctggcattgccttttgttgagacttaaaccattggatattgagtttacaaagcatttgcatgaaaaagtgaatatcatcccacttattgccaaagcagacacactcatgccagaggaatgccaacagtttaaaaaacagataaagaaatccaagaacataaagttaaaatatatgaatttccagaaacagatgatgaagaagaaaaaaaacttgttaaaaagataaaggaccatttacctcttgctgtggtgggtagtaatactatcattgaagttaatggcaaaagggtcataggaaggcagtatccttggagtgttgctgaagttgaaaatggtgaacattgtgattttacagttttaagaaatatgttgataagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgagtctgcagatgtggatcctgactcctgagagaagtagctcaccgtgacgaagctgcgtttgcttttatcgatttgcaaatcaaagaagggggacatattgggagaaggccccccaaaatctggccataaactggccacaaaactggccataaaatctctgcagcactgtgacatgctcatgatggccataacgcccacgctggaaggttttgggtttaccggaatgaaggcaaggaacacctggcctgcccagggcagaaaaccacttaaaggcattcttaaaccacaaacagtagcatgagcgatctgtgccttaagggcatgttcctgctgcagataactagccagacccacccctttatttcaggccatcccttcatttcccataagggatacttttagttaattgaatatctatagaaacaatgctaatgactggtttgctgttaataaataagtgggtaaatctctgttcggggctctcagctctgaaggctgtgagacccctgatt

SEQ ID NO: 77826 - DNA, 1628 bp, Homo sapiens
tcttccaggatcgcgcattagcggacgctggctacgggtggccgggcgggatgtaaccggctgctgagctggcagttctgtgtccccaggcttcggcccggccgccgccgcacataaactgcgaggaggagctttacgacttctcggtcttcggggccgggcgcagcaagggccagactctgcgctagcaggcgctgcgcgccaaccggccggcccctgtcgcagaaggtgcaaccgatcgcactgtcgcgcagaagctcctcaatggccagcgccagctgcagccccggctgcccactcgcctcacctgagcctgggtggaacaatccaaagttttaatcaaagaaggtggtattcagttgctgcttacaatagttgataccccaggatttggagatgcagtggataatagtaattgctggcagcctgttatcaattacattgatagtaaatttgaggactacctaaatgcagaatcgcaagtgaacagatgtcagatgcctggtaacagggtgcactgttgtttatacttcattgctccttcaggacatggaccgttacataactgaagactcccaccttcaggcaggattgggtagtacatgtttgtaactacctggcattgccttttgttgagacttaaaccattggatattgagtttacaaagcatttgcatgaaaaagtgaatatcatcccacttattgccaaagcagacacactcatgccagaggaatgccaacagtttaaaaaacagataaagaaatccaagaacataaagttaaaatatatgaatttccagaaacagatgatgaagaagaaaaaaaacttgttaaaaagataaaggaccatttacctcttgctgtggtgggtagtaatactatcattgaagttaatggcaaaagggtcataggaaggcagtatccttggagtgttgctgaagttgaaaatggtgaacattgtgattttacagttttaagaaatatgttgataagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggaactgatttcatctgaaattgaagagacaatcagagaaaaactatagaccactcatgatggttgttatatgtgcttggctgggccatgggtcccagtgtttggtgaaacacagcagcagatgtccctcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77827 - DNA, 1114 bp, Homo sapiens
cgatgagccggccataattggaagtggagtgtctctacttggacccaccaaccctgctcctatggctccacccagaagccattcagcctagaggacagctctgaccccccctgtgatttcatacaatcagcagcaagtaactgttacctcaccatccccaccccttctgccagactgcctttgaaaaacctctaacctgtgagcacgagatgattccagaacaaactctgtctcccatgtggcatgaccagccttgggtctcttaaactttttctccactataatgccatggtctttatgcagcaggcaggaagaattcaggtggttataattccgtatgtgctttttgaacatttttctactgggctattgctctcttcataatgatttttttaacttctctctataaggaactgatttcatctgaaattgaagagacaatcagagaaaaactatagaccactcatgatggttgttatatgtgcttggctgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcatgtaagccaattccttaaaataaattctctgtcctgtttttgccccctctctctttctgacagcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77828 - DNA, 1882 bp, Homo sapiens
aaagacaaggtcttgctatgttgcccaactggcctcaaactcctgagctcaaagtgatcctcccacatgctcctcccacatcacatcactataggcacacaccactgcccctggtttattttgaacagttctttaatttttaggatattgtttcaagttactgtccttattgacaattttcccaccagtgacccctgtaccttgttcccagctctctctgtcatgcccaggcaactttcagttgctgagttgaggctttagaacttacataccccttaaaaataggcaccagagaaattgatttgcatctctcttttgtagtttacctctctactcccaagtaatattcctgtttgtgatacattctttaaaaataaaagtaaagaatcttaaagttcttggctccctttttcattttggttaccttaagatttttttctaaagtgattcccccttcacttacaccactgaattttttaaatgtattatataataaatatattttttaccaataatgagaaaatgtgtgatttcccctttcaaaatttcaaagttgtttccggagagctcattttagttaggttgacatctgtttctgaggattaaactacagtaaggtaataatatagtacacttctctgtcatgcccttacattgagtactatgttagtgttaaatctcaaaaaaattgatctgagctgttttgcatttcccctcccttgtttttaccccccaagttcctgtgaaatattttttgaaaagactaggcttagtgaaaatataatatttgcggtctatttttttcttacagttgaaaatggtgaacattgtgattttacagttttaagaaatatgttgataagagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggaactgatttcatctgaaattgaagagacaatcagagaaaaactatagaccactcatgatggttgttatatgtgcttggctgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcatgtaagccaattccttaaaataaattctctgtcctgtttttgccccctctctctttctgacagcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77829 - DNA, 1567 bp, Homo sapiens
tgatcatggctagctgtttcatgtgtacactcgtgactacgaactcctagtcatgacgaagtaaagtacgaatcttaaagttcttggctccctttttcattttggttaccttaagatttttttctaaagtgattcccccttcacttacaccactgaattttttaaatgtattatataataaatatattttttaccaataatgagaaaatgtgtgatttcccctttcaaaatttcaaagttgtttccggagagctcattttagttaggttgacatctgtttctgaggattaaactacagtaaggtaataatatagtacacttctctgtcatgcccttacattgagtactatgttagtgttaaatctcaaaaaaattgatctgagctgttttgcatttcccctcccttgtttttaccccccaagttcctgtgaaatattttttgaaaagactaggcttagtgaaaatataatatttgcggtctatttttttcttacagttgaaaatggtgaacattgtgattttacagttttaagaaatatgttgataagagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggaactgatttcatctgaaattgaagagacaatcagagaaaaactatagaccactcatgatggttgttatatgtgcttggctgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcatgtaagccaattccttaaaataaattctctgtcctgtttttgccccctctctctttctgacagcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77830 - DNA, 2002 bp, Homo sapiens
aaagacaaggtcttgctatgttgcccaactggcctcaaactcctgagctcaaagtgatcctcccacatgctcctcccacatcacatcactataggcacacaccactgcccctggtttattttgaacagttctttaatttttaggatattgtttcaagttactgtccttattgacaattttcccaccagtgacccctgtaccttgttcccagctctctctgtcatgcccaggcaactttcagttgctgagttgaggctttagaacttacataccccttaaaaataggcaccagagaaattgatttgcatctctcttttgtagtttacctctctactcccaagtaatattcctgtttgtgatacattctttaaaaataaaagtaaagaatcttaaagttcttggctccctttttcattttggttaccttaagatttttttctaaagtgattcccccttcacttacaccactgaattttttaaatgtattatataataaatatattttttaccaataatgagaaaatgtgtgatttcccctttcaaaatttcaaagttgtttccggagagctcattttagttaggttgacatctgtttctgaggattaaactacagtaaggtaataatatagtacacttctctgtcatgcccttacattgagtactatgttagtgttaaatctcaaaaaaattgatctgagctgttttgcatttcccctcccttgtttttaccccccaagttcctgtgaaatattttttgaaaagactaggcttagtgaaaatataatatttgcggtctatttttttcttacagttgaaaatggtgaacattgtgattttacagttttaagaaatatgttgataagagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggtactagcaattccaaattatccagagcccttctaagttgtaagatctgaaagaaatgtctgccatctatattctcagccacacttagtttcttaatctgcaagatggaattaataatagtacttactttatgatgctgttgcagaaattcactgagttgctacacgccaaacactgagaacccagctgggcatataataagcattctattgcatggcattattgcatcatttttacttctattactgctactgcttgtaactgcttgtaactgtttgtgcttttttgatatgaaagtccaccatcagggagcactgtagtggaaaaggtattaggccaggcatagcctttagttctctggccttgggtccttcatctgtgatattcagttaacaatacctagccagtaggggtgttaaagattaaataaatgtgagaatgtgcctgttgcttaatcttcctcaaagggttatggactctcagagccagaagaaggtcatctctcctttgctcctcgtatgctgggatctgccacatcaatggcaacagctgggcctccagaatttgctccagggtgtttggaagtcctgacaccctcctgatcttctctgtaacatgcacactttggcctgtgtcagtttgctggaaccacatcaggccggccctcttcctgggacaaaattctttctttttctttctttctttttctttctctttctttctttttctttctctttctttctcttttcccttccttccttccttccttccttccttccttccttccttccttcccttttcttttcttttctttctactgtgac

SEQ ID NO: 77831 - DNA, 1067 bp, Homo sapiens
aaagacaaggtcttgctatgttgcccaactggcctcaaactcctgagctcaaagtgatcctcccacatgctcctcccacatcacatcactataggcacacaccactgcccctggtttattttgaacagttctttaatttttaggatattgtttcaagttactgtccttattgacaattttcccaccagtgacccctgtaccttgttcccagctctctctgtcatgcccaggcaactttcagttgctgagttgaggctttagaacttacataccccttaaaaataggcaccagagaaattgatttgcatctctcttttgtagtttacctctctactcccaagtaatattcctgtttgtgatacattctttaaaaataaaagtaaagaatcttaaagttcttggctccctttttcattttggttaccttaagatttttttctaaagtgattcccccttcacttacaccactgaattttttaaatgtattatataataaatatattttttaccaataatgagaaaatgtgtgatttcccctttcaaaatttcaaagttgtttccggagagctcattttagttaggttgacatctgtttctgaggattaaactacagtaaggtaataatatagtacacttctctgtcatgcccttacattgagtactatgttagtgttaaatctcaaaaaaattgatctgagctgttttgcatttcccctcccttgtttttaccccccaagttcctgtgaaatattttttgaaaagactaggcttagtgaaaatataatatttgcggtctatttttttcttacagttgaaaatggtgaacattgtgattttacagttttaagaaatatgttgataagagaacacacgcaggacttgaaagatgttactaataatgtccactacgagaactatggaatcagaaaactggcagctgtgacttatcatggagttgataacaagaagaataaagggcagctcactaagtaagtatatatttttttctccaaaaaaaggtattctttctgtagtcagtaatcatattgtttcattttcattaaatt

SEQ ID NO: 77832 - DNA, 474 bp, Homo sapiens
aacaaaatggagaaatttctacaagcaagcactgtttacaataaaataatatagacttcaatacataagtgcttggacatagtgtattaggtatgacagcataatagagtacttacaatgaattattaaagttataatgaacaagtgtgagttgggaaaaataaaattataagccattccatacaggtggcataagaacactaaaaatgagagtttggggtggatgtatgcacaaaaactagtgttaggataataataattgaccagacttatttgtgtatgaatgaaaaagagggaaataacctttactgaactaaagacatgcctggataaattacacacagttaaaggagagaaaattagggaatgtgatatttttgctaacaggttgggccttatttataatgtagtgtcaaggaaactcctagcgtcgcaacattgggcagggtaatgacaaaacatcccagcagacat

SEQ ID NO: 77833 - DNA, 304 bp, Homo sapiens
ttaatataagaatccacagagcagtagtttgatagatatctgagaatagtaggaaaaaaattgggtaatcccaaaataaatcagtgatttcagtatgaagttttctcaacataaatctgctataattaaaaattacaggccttcaggaagtgtcgagtctgggacgcccagcgcgggcccgagcagggggaagggaagcgcagctcggtccgcgtgggtggaggggacgtgaagccgccctgagatgatggttgaggaagggctctacggctcccaagctaggccaaatgcctccggcggccgc

SEQ ID NO: 77834 - DNA, 1039 bp, Homo sapiens
  misc_feature (19)..(19): n is a, c, g, or t
ctcgtccctatatcttgtntagaacacacgcaggacttgaaagatgttactaataatgtccactacgagaactatggaatcagaaaactggcagctgtgacttatcatggagttgataacaagaagaataaagggcagctcactaagagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtacagcggaccttcctggcatcagaaaaaggcctccagaaaaagagacacaggaactgatttcatctgaaattgaagagacaatcagagaaaaactatagaccactcatgatggttgttatatgtgcttggctgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacataacctcctccctgcggctctagcctgctggcctttcctatagacttcagacttgccagccccacaatcatgtaagccaattccttaaaataaattctctgtcctgtttttgccccctctctctttctgacagcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaatgaacttatca

SEQ ID NO: 77835 - DNA, 1682 bp, Homo sapiens
tcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctggtagggccctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccgggggggcatccagcccgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatgttgaagtctcaactgtctctgttcacaagagccaccaaaagttaggggacttcagtcctagcccccagatggccgccctgaagctctctgggctcctcagcaataaagcactttattttcaaat

SEQ ID NO: 77836 - DNA, 408 bp, Homo sapiens
ctcccaaagtgctaggattacaggcttgagccaccagcctagccataaatagtttttttaacgtagcttacaatttagtagaacttagattctttttaatcagcatattgctgaccagttttatgaaggactctgtgctgttcactatggtagtcataagccacatgtagctattaaaattaaataaacttaagttcatgaccagaatggccaacatggtgaaaccctgtctctactaaaaattcaaaaattaatcaggcgtggtggcaaacacctataatcccagctactcaggaggctgaggcatgagaatcacttgaacctgggaggtggagattgtagtgagctgaggtcattccactgcactccagcctgagtgacagtgtgacactccatgtcaaaaaaaaa

SEQ ID NO: 77837 - DNA, 401 bp, Homo sapiens
gaggaaacaatagggcagaggaaacaatcagatatgcatttgtctcaaatgcatataatattcagtcatgagcctcagagggatgattgagttccacaaggaaattccttgtgggcaaattggaggaaagtatgtcgctttttaaaatctttgtagctatcttatttaggaataaaatggagccaggtgcagtggctcacgcctataatcccagcactttgggaggccgaggcgagtggccttatgcaggcttcatgcaggacaggaggtagccctgagctggtaggatttggacagatgaagcaaatgagtgaaaggtcattccaagtcaagaggtcaggagttcaagagcttgtgctcaggaattagagaccagcctaggtaacatggcgaaacccctt

SEQ ID NO: 77838 - DNA, 740 bp, Homo sapiens
aaataatccagtaagtaacgttccaaagcttcatcaaccctgtgccaaactttaacagtggttgaatcttccctggagcagcaaaatctgacactcaacaacaggagaggcagaaggagcagctgccaggagcaatgtacctaccccatcgctttatcttgcaactgctggcaccatccccttcactttcaggaaccattctacatcaaactctgctttccaagaacttttcctctacacattccattctcctccccctataccataaagcttctggctaatgttcatggcatgaatgatactgccttcaaatggcaaagaatagcactttagtatcagacagacaggttcaaatcttagttccatgactgactagcttttgttccctggagcaaattacttaacctgttttgcactctcaattttctacatataaaagaacgctagtgctcacttcacagtttttagaagatgggagaaataaattcagtgcccaagtgtttactcagcaaatacgtttttcttcccttgtgcaccaaaggaaaaaaaactgagggtatcatataaaatttgggagaagggagaggccatagcatgaccaggtcttttttaaaagttttatgttcataataaaagtcatgaaacaagagaatctaaaggtcttagcattttagacttcactgtcaacaggaaaacttccagaaatcatacaaaaaggatgaacatacacaggcaagctt

SEQ ID NO: 77839 - DNA, 1719 bp, Homo sapiens
ccaaaggacttctatgatgaccacgtcttaacccccaaatctaccatcaaataaattggacgtgataaacatgcatgtgagattcttaaattcggatgccattctcagcctatcttatgcctgcttggtgcaagaaacatgagtcttagggtcaagtgaacaggggctggaatcctggctctgccccttatttactacaggatcttgtacaagtcacttcccctctttgtctcagactcttcattcataaaatacaaatatcaatcccttcctgccaggctgttttcagagtcaaggatatgtatataaacactgaccagtgtttctggtacatggaaaacactctggaaatgccaattctgtgaacactcagtaagggcttgaggttctgttcatcgtctgagaccacaaagaatggaaatagaagggttccaggctggttcatagcacaggccattctccatttaaattttaaattaaaacaaacatatgaatgtaaaaactgtcaacactgcacaaataacttgaaatcttagaaacataaatattgaatgaactgaatgaatacagaaaaagtattatttgaaaagtgaggtggaatgtcagacttcaataatgtaaggtataatttaatgctgatacaaagttagtaccattaagtataaaaaaaaagaacccttttcttaaaataagaattaatatttcctagagactcttctgagtaagatttctacgacctcctcttggtgattaaaacaacaacatcaaagtcctaaaatactgtccaagaatgagaaattaaaataatttgaaaacacagaaaattcatgtcttaaaatcaaagatttaagaaggaattcctgggcaaggtattttcctactacatctgtggattcattttaaagttgataataatccagcaggaatgagaaatcagtgtttcttaatgatgccaaataagtgaaaaatgctggatataccacataaccttttggaggacataaggcagtagattctctaaagcaaacagcggaagtgtaagggagattgtgcgatgtagtttagaaggagggttttctcccagaaattggctgaactagatatgatgtcatatcttagctctgccactgttgagctagatgacttttaacaagttgcttctctctgagtctctattaccactggtggtccaaagaacacattcatactaaaagctaaagaacagacagcacttaaaggtaagaatctggatatgccagagggttctccatcctgtctctccaatacctcaccaccacaaaatgttttacaggactgctgaagcagacagacggattagacagataaataaatagataatgaatgaatggatgaatgaatgattctgataaatcacaaaagctctccagaggaaaggttcctcaagaacctcagcagatggtactgggttcttactgaatgctaatcaagcagaaccttttttccagtcattcatctaatcaatattaagcttctaatatgtatcatgtacagtattagacacaggttgaccaaatatattacctgccttcatggagctaacaagctataaactgggataaccatgggccagaagccctatcattcaagaaatggcaggggccagcgacggtagctcacacctgtaatcccagcactttgggaggcaaagctgggaggatcactagagcccaggagttc

SEQ ID NO: 77840 - DNA, 494 bp, Homo sapiens
tctgttaggattttattttaatattcatcttggattccaactagatttcactttttttaagtgattgctctagtgattacaatatacctccttaacttttcagtttgtttacaggtgccctttatttttattttgttgttgttgttgtttttgtattttttttctttctttttgagacggagtctcgctctgtagcccaggctggagtgcagtggcgcgatctcggctcactgcaagttccgcctcccgggttcacgccattctcctgcctcagcctctggagtagctgggactacaggcgcccgccaccatgcccggctaattttatgtatttttagtagtgacggggtttcaccgtgttagtttacagtttatattgtatcacttcatgtaaaatatagaaaacttgaaagtatataatcccatattccctccctgtcttttatgccatagttgtatgtaatactctacacattttgtaaatcccacaattt

SEQ ID NO: 77841 - DNA, 438 bp, Homo sapiens
aatctgtgaacatatatttttatttatcttaaatacctaagagtgaaattgttggttcatatgtggttatatattcaactttgtaagaatctaccaaaatgattttccaagtatatgtataatgttatggtcatcagaactacatgatagttagagttggttaacatactcactgcaatggattgacttttctgtgattcagctatcccactcttaggcgtatacccaagagaaactcataatgtccttgtgtgcagcttgtatgctaatgattttagtagtattttttgtaatagccaaaaggtggaaacaatgaaaactttcatgaaatgattaatgaattaacaaaatattatatatctatatattatcattaatcaatgaaaagaatgaagtggtatacaagaaacaacacagataaaccttgaaagtatacta

SEQ ID NO: 77842 - DNA, 495 bp, Homo sapiens
acaattccttggtacccacaaatatccagcctacatccaacttctcccactttctccaaacaaaaggttttttataggtttttcaaacccagatcgcatcaaggttgattcactaagactctttggtctcttttagcctcaaaacactacccaaccttttctttggcttgttttatcatgacataccaccttgtgaaaaccaggctccaatcctggctgtaccattcacttagtctgttcccttggcttgtatttaagaactgaactttagtttctccgtctgactttcctcatatatcatcctcattttacaatctcactatgtgtattagaagaacatccaattaccacgtgcctgtggttgatgattccaagtgggttcagtgctaatcagtcaggaggtgcactgcaggctgtttaccttgggtctgattagcataacattcttgttcctcatgggcttggccagttatcttttcataaggagatcccagc

SEQ ID NO: 77843 - DNA, 436 bp, Homo sapiens
gtcatgcatctgagaggctgccatgatttctccccaaaacacattggcaggtgtaaaattattgaatgaacccatcccacatgtgggctgtgtttctggctgggtttgacccacatgcatgtctgtgggctgctctgtctagactcttcaatattccagccacattttgtgccttagaatgaaattgctgtcgagatattgatctccgtttttgtcggggtgcaggaattttattctatgttgtcaggatcccctctggatggtgtaataatattgtgagatagttctttagcatatctttaaatcttcatatttattttgaaaaaattagaaattttagaaatatgcattcattttttgcaccatctagaattaacaactgatagtattttgacttattggcttccttttttaaataaaaaattaaaatattaca

SEQ ID NO: 77844 - DNA, 1024 bp, Homo sapiens
gggtgcactgctcatcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagggcagaacggctgcatcccgctggtcgacccttttgccagtgagagcctggacgtctccacctcggtgcagcacctcatcttgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtgggggggcaaggagctgagcggatccagatgtacccctctgccccctcccttgttctcaaggcctgctaggtacttttcactgagcccttcccgggaagaagcaggcacccagttcttgtccttgtcctggccaggctgctgctgcttccggccccgaccttccttttgcagcaacccgggggaggtatgccactgtgagtgccctggtgggcacactgagctgg

SEQ ID NO: 77845 - DNA, 440 bp, Homo sapiens
gcctttaaggacaaatccagaccctcagataggggcagaaaagcaaagaatcacagattcttagagctaacatcttaaagggtctagaactgtccagatttccaatattctgcctcattgttttcatgagcagtcagaattacttagaaattccagacggttgaccaggcacggtggctcacgcctgtaatcccagcactttggggggccaaggtgggtggatcacctgaggtcaggagttcgagaccagcctggccaacatggtgaaacccccgtctctactaaaaatacaaaaattagccaggcatggtggcacacacctgtaatcccacctactcgggaggctgaggcaggagaatcacttgaacccaggaggtgggggttgcagtgagccgagatcacaccattgcactccagcctgggcgacaagagcaaaactc

SEQ ID NO: 77846 - DNA, 761 bp, Homo sapiens
tatttcattcacgggcgtgggctttagattggtaaattacatggccccttgtcttacaatttacaatcagtgggagaccgtggaaagagagggagagggagaccgtggggagagggagaccgtggggagagggagagggagagggagagggcttttgaccatttttaaacagggttatttgttttcttactattaagttgagttccttttatattttagatattaaacctttgttggatgtatactttgcaaatataatattttctcccattctataggttgtcgcttcactatcggttgtttcctttgctgtgcagaagctttttagtttgatgtagtttgatttgcccattgtttgcttttgttgcctgtgcttttgaagtcttgttcataaacttcttgcccatataaatgtaatgaagcatttctcctgtgtttcctctagcagtttcatagtttcaggtcttaaatctatgtctttaattcatcttgagttgatttgtgtatatggtgggagataagggtttaattcattcttctgcatgtggattttcagttttcccagcatcgtttattgaaagactgtactttcttttcaataaatgtgtgttcttggtgcctttgttgaatatcagttgggctgtaaatgtgtggatttattcctgggttctctgttccattgatctatctgtttttataccagtaccatgctgtttttataactttagttttatggcatattttgaagtcaggtattatga

SEQ ID NO: 77847 - DNA, 213 bp, Homo sapiens
ttttttttttgtatttttagcagagacaggtgtcactgtgttggccaggctggtttcaaattcctgacgtcaagtgatccgcctgcctcagcctccaaaattgttggtattacaggcgtgagccaccatgcccggcaagttcaatctttacaaaattgttttagaaacagggtctcactctgttgcccagggtggaatacagtggcatgatca

SEQ ID NO: 77848 - DNA, 627 bp, Homo sapiens
aacagtgctgttgaatttaaccctggtaaggtaacttgatagtttatcttcacaggtgtgagacaaagaacagaactcaatcatccctctgctcacctgagacaaatgcacatctgattgctttctctgccctattgtttatgtaaaaattcagattcactaagccagactaaggattcagtaaaaggctaatcagagactcaaaagaatgcaacaacttgcctcttagctacctatgacctggaagcccccacttcaagttgtcctgtatttccagactgaaccaatgtataccttacacatactgactgatgtctcatgtctccctaaaatgtataaaaccaagctgtgccccaaaaaccttgggcacatgtcatcaggacctcctgaggctgtgtcatggggtgtccttaaccttggcaaaataaactttctgaattgattgagacctgtctcagatactttgggttcacaacaggctacatctggccttgactggcttggactggttttgactggccacaattggtttatgtcagttttgactggtcttggccatttccaacaagtttacaccagtttcacctgaccacaaacggttcagactggctctgtctggctactatc

SEQ ID NO: 77849 - DNA, 459 bp, Homo sapiens
atcactctgtatgcctttgtgtactcatagtttatctcccacttataggtgagaacatgcagtatttggttttccattcctgagttagttcacttagaataatgtatccagctttatcaaagttgttgtaaaagacattatttcattccttttttatggctgagtagtattccgttgtgtgtgtatgccatgttttctttactcatttaacttatatatttttcaacaaaaacataattctttgaagaatgacagatgtctgatatcaatcaacatggataaaaggactaacttcttccatgtaataaacatgttcatatttctctgaaatgacagaataggccttttccccttttatggtccatttcactatggtgtttaattgatcagtcgagaatgaagaaaacattctttgaaaagtatctgccagaattttgtttagaatggtcagccttaact

SEQ ID NO: 77850 - DNA, 527 bp, Homo sapiens
cacagcccagcctcatcaatggggctcagaagtctctgcatgtcagtgtgattgcctccatgtctccagccttctgatgtggctccttgcaggtccctgactgcttggccaagcccggcccatgcatatgtgtagagtcttgccttgggccttctcgagtatcccttgatgttctgcccaggaggagggtcccccgtcttcaccgatggaataggaagaataatggcctcccagacacgcccatgccccagtccccagccgctgtgaggatgctgccttgcacggccacagggactttgcaggtgtgatgaagatatggaccccaagatgacagacctccctggattaagtgagcataatggaatcacaggcccttaaaagtggaagaagaaggcaaaagagtccaaaaggtgaagaggccaggtagacagaagctctgtgtgggagagggagctgagccaccactgcaggctttaaggtgggggaagggttgagaaccaggcccatgcctgatctctaggagctga

SEQ ID NO: 77851 - DNA, 836 bp, Homo sapiens
agcgcgtaaatcacaagtgaaaaacaccatcagcatgaaaagtaaaagactgaacctgagcctctgaataaaacctggatttgaaaaagcctaatttatatataatatatatttaagaaacatagaaaaacagcaaagataatttctctctagcatataacataggcaacaaaaacaaaaattgaaataaaaaatactgggcaccctcacaccatgttgtgacattcatgtttacacttcctgttgatatagattactaaagaataggaaactaacacaaataggtccacatgtaattaaggcatttttttcataatccagatcaaataagagtccatataaaaagcagttcttcttaaataaaagttcacattaaaaaattacatctcacaggaggaaatgaaccaacatgaggaattatcccaaaatagtggttgggactatgctaatgcccgtggcccaaatgtggcctgaggattatttttgtaaagatgttaattagcaatggttcttaaacttttaaagagttctaaaataaaaaccaaagtatataaaaaagagagaatatgtgatatacaacacttaaaatatttactctctggcattttccagaagaaaaaattgctgaccccaattaataaatatctatttgatagtctcagaattttctgacttctctggctgtttttcattgatgcagaaaaagtaattgataaaataaaatactactttattatgaaaatgttcggggccgggcacagtggctcatgcctgtgatcccagcactttttgggaggccgaggcaggtggatcatgaggtcaggagatcgagacca

SEQ ID NO: 77852 - DNA, 3549 bp, Homo sapiens
  misc_feature (2075)..(2075): n is a, c, g, or t
  misc_feature (2593)..(2593): n is a, c, g, or t
  misc_feature (2660)..(2660): n is a, c, g, or t
  misc_feature (2973)..(2973): n is a, c, g, or t
  misc_feature (3018)..(3018): n is a, c, g, or t
tcaaatgcccctttcattatgaaactcttttttaacttttaatttaagttcaggggtatgtgtgcagatttgttacataggtaaacttgtgtcatggggctttgttgtacaggttgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggagtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttaggccgggcgcagtggctcatgcctgtaatcccagcactttgggaggccaaggcaggtggatcacctgaggtcaggagttcaagaccagcctggccaacatggtgaaatcccgtctctactaaaaatataaaaattagccgggcatggtggcgggtgcctgtaatcccagctactaggggggctgagacaggagaatcgcttgaacttgggaggcggaggttgcagtgagccgagatcactccactgccctccagcctgggcaacaaagcaagactccatctcaaaaaaaaaaaaaaaaaaaaaaaaaaatgtccctcatacctaaaccttacctcttgctaatttgctgagggttcattttagataaaaggtgtttaggttttcatattatgtttgtaactgtatagctatgattcagtttcctaaatgaaaaaagaaactgttttaatgtacagactatttagatttgaaaagactgtgagagctttttcttttatagcaagacaagtcaagaatagaaggcacactgcgagagggatgtcttttgaaagaaaagaaacactactttttatattctcaaatcactgaagaaagctttagacataatttcaaacactagctcctgtttaattcagatgcacagaatgcattaaaaccacgagtgtagtggacgtgatttatacattctcttagcacaaatcagtacctatcttcactgtaattagacttttcttcctttctccttctcaaaagctacttttgaaaccttatgttttccctggacatattttctgtacttcataaaatagctcagttctgcaacnaactgcaaatatttgcaaaagggaacaaatgtaaaataaacgtcccctaatgcagtgtttggtgaagaaacatatgtctgacattagttggttaacctgaaaaatagtaagaaacaactctacttaggggaaagggggtagaattgagcccgtactgtgcaaatcaagagaaagctataatttacgcaatttttattaaagagaatacaagtgctgtaggcttggggtggtgctaggtcatatttaagcctaattgagctttttctatatcattagaaaaatgggccaagtttcctatattatagggtaaatacaacattttcttcctgcaaatattaaataccactggctttttaagacgtaaacatccaaatctcaaatgtctttattcatgccaatgcaatacaataaaaatattccccatatacacttaaatcactgcaagtaagccttagaatccccacaagtattattacttactatatctcagaaactttcacacacattatttcaaatanagttctcccaaaaaaaccctgcggagagatacctgtaaaccaaggctgagactagcctagacagttngttctttagacaacaggagtggagatttgaacccagctattgtgactcaagcaagcctagggcatgtttctgagatctctaaggtgtgcgctgtgaaaccggtggctcattttatgggttggatttccaaacacgactatcacaatcatgccaggaatcaatgactgacttcttgcctccgtggcctgaagttctcctctgcacctcctacctttttgccatttcagtgatgcaccaaagggtggagttgaagaacatcagttttgctgctgcttgttggcaatactctcaaaaaggcgtggggagggagagntgtaactcacccctgaagtcaagcctggagattacttgtcaggantgtcaaaagcatttgttaagcaaccttcttcctggcattttaagaagaaagccgcatacatagatcaaatcccttccttcagaaacctgtactctctgaacagagccttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaagggacacatttggcactttttttttttgaaatggggtctcactccagcctgggcgacagagtgagactatgtctcaaaaaaattaaattaaaattaaaattgagcctgatgtggtggcacatgcctgtagttccagctatgcaggaagttaagatgggaggatcccttgagcttgggagatcaaggctgcagtgagctgtgattgtaactactgcattctagcctaagaaacagaaagagacactgtctcaaaaaaaaaaaaa

SEQ ID NO: 77853 - DNA, 2567 bp, Homo sapiens
tcaaatgcccctttcattatgaaactcttttttaacttttaatttaagttcaggggtatgtgtgcagatttgttacataggtaaacttgtgtcatggggctttgttgtacaggttgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggagtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttagtgctgggattacaggcatgagccatgacacccggcctgtaattttctttaaagactgccactgggtggaacccactgggcccagtgagaactacggaaaagagacccattcttgccctcattgttagtgtccacatccggatttacctaaaccccacccaggtggcatttgcatagtaatgaaaaaccggtattttctagctgtgaatcacacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaaggtacaggagtggcctgattctggggtttccctgccccccctggggtccctaaactgctgtgtgatatgtttctaactatctggacagctcacccaagagtcagttgttcccagtcgcttcttgctgaggataagccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgaccaaaaaaaaaaaaaaaaaaaaaagctgcttttcccctcacttctccctctggttctgcctcagtactttgcttaggagtttctaaaagcaggcacagttgcctgcggggctggtgtgtgtcaccttcgcaaagtgcagatgaggtctggcatgtcccatcttgttcctgcctgactacaactctgcacacagacagtgttgatctggcttggagcccatagtggcaatccttggagtggaggcagcagagatctcagttcttcctagtgcttgagaagttaactaactgtctttcccatgaggaaaatgttttgagactgtagaagcagagaagagacttcgccaaagcccatagaaaataaaaagcaaaccctcaagcatgaaaatc

SEQ ID NO: 77854 - DNA, 183 bp, Homo sapiens
ctcaagccatccacctccctcggcttcccagagtgctgggattacaggcatgagccatgacacccggcctgtaattttctttaaagactgccactgggtggaacccactgggcccagtgagaactacggaaaagagacccattcttgcaagccgaaacccagcacactgcgccgtactagatc

SEQ ID NO: 77855 - DNA, 253 bp, Homo sapiens
ataatgcaaataacagtgcaattatcaacagtctgattaagaatatgtcttaggactttgaagaatacagtttcagtggagtaaactattttttgtgatctgtttacttatattatcctgactttaaacattttttagcataagaaaatagtaaaaaaatattttaatgatataaaatccttggctactagctaggagtcgctctgtgctatagtagaaaaatatggagactgggagctgtgtgatctatttt

SEQ ID NO: 77856 - DNA, 407 bp, Homo sapiens
cttttaggctcatctacagggccagctagagccctcgccgccatgtcatctccttggataacctttctttgcagtggccctcagctgcaaaagcctaagaacaaatccagaggaagctggcctccgaggaggaatgcacacggaaccaccctgtctccggggagcttggagttttagttttgtccaagctcgcagggcaaggctgcccactcatcttgcggagggacacagctaagaggggcttttgtggaggttctcctccaagcaaagatcctggtttgggctctgatctacacacaaaagtagcaggaccctgcagctttgttgacaaaacatttggaaaatgcacccatgccaccaggccacctgcctatttctagcaatcacttctggttgaattctttaaa

SEQ ID NO: 77857 - DNA, 587 bp, Homo sapiens
gatcttgttaaatttagattctgatttggtagatcttgagttgggtcagagataacaaaccctcaggtgacggtgaagttactggtcctgggaccacagtttgattagtaaggatatagggccttaagggccatgtaagactatataaatatgaaactattgaaatcaccaagggaatgagggtaaatagagaagaggaaagggctaagggctgagccctggcgcactccagcattaagaggatggcgagacaggaggagccagcaaagaagcctaagaaggcgtggccacaaagcgagaaggaaacccacagggcccatgaatgtaaataaatttcaggcaacatcagtcagtatagttttctgtgttttctccaggaagccaagtaaattgtttcatggaggaagaagtgatcaaccgtgtgaaatcttgcttgataggtcaagtaagaggaaagctaagaattgattattgagtttgacaacatagtggttattgacaagcaggtagctgggtagcgtgagggcaaaaggcttattggagtgggtttcaaagagaagagaggagagaaatcagagatagtgaat

SEQ ID NO: 77858 - DNA, 327 bp, Homo sapiens
ccagggttcacggccacccccactgccgtttcttgcacctgtactgtgagccttgcacccactgcaagctctgacagctttggctctcagggcctggccagcacctacattctgcagatgaggaagctgaggcttagtgagtaacttgcccagagtcacgaggttaggaagtggggtgtatcaggatgagattcagactctggtcctttttttttttttttttttaaacgagacggagtcttgctttgtcgcccagcctggagtgcagtggcgtgatcctggctcactgcaacctccacctcccaggttcaagcgattctcttgcct

SEQ ID NO: 77859 - DNA, 540 bp, Homo sapiens
agcacctctgtgcagcattccttcctccagggtatggcaggacctttctcaaatgaggatcttatggcccacaatcagaaaggcaggggaagattagaggagggcaggggaaggtcagagagagagattatattttctgaggtctgctcctgagacttaaagcactccaacattataacagaagactatgggagttatgccaacaaccatggatgaaaacatgttttatatataatatatatattatatataattatatattatgtattattatatataattatatattatatatattttatatatactcgcaagaggttaattcagaaaattgctactgtggttgctactttttgtcctttaacaaccaatttaaagtaaaattttgactgaaatagcaattgatttttgagaaatgtcagcaatcgcaatgataataattttttagccattatcccaaaggaaacgagtgatgttttcaaaatgtacttcaatccttcagcaataatcagataaataaatttcctgtaaaattataat

SEQ ID NO: 77860 - DNA, 362 bp, Homo sapiens
tagacacattggcacggtgactcacccctgtaatcccagcactttgggaggccatagtgggaagatcacttgagcccaggagtttgagaccagcctgggcaacatagtgagacaccccctccccccgccatcttaacaaaagaaaaagaaatttaaaaataaaaaataaaataaaataaaaataggcacatggttagattgctaagacatattactaggtggggaggaaaaaagaaagttgtacaatgtgatgtcattttaaaaattgatgatagatgccaggtctgatggctcccaagggaggatcgcttgaggtcaggagtttgagaccagtctgggcaacatagcaagaccccctctct

SEQ ID NO: 77861 - DNA, 327 bp, Homo sapiens
ttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgtttctgaattaaca

SEQ ID NO: 77862 - DNA, 704 bp, Homo sapiens
ccggatccacttttcggcaaagtgacgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccaggtaaaatatgattcagttattgtagtttttaaaagtgaatacaggcctggtttgctttgagctaaagttgctagatttactttggcggtaaagtaaaaggttcaaataattttgaggattgtttgatccataattgttattttatttttgtggttataaacattttttaaaagattctttagttaa

SEQ ID NO: 77863 - DNA, 3672 bp, Homo sapiens
ccggatccacttttcggcaaagtgacgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagtggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttg

SEQ ID NO: 77864 - DNA, 3560 bp, Homo sapiens
ccggatccacttttcggcaaagtgacgtggacgtcaacagcaatggcggaaggagaagatgtgccgccgctgccaacgtcgagcggcgacggctgattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagtggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttg

SEQ ID NO: 77865 - DNA, 3717 bp, Homo sapiens
ccggatccacttttcggcaaagtgacgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcgaatgtctttcaatcttccttggccagacagatcatgtacagagcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagtggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttg

SEQ ID NO: 77866 - DNA, 2749 bp, Homo sapiens
ttaatggctaacaatgcttctttattatgggagagattgattgatatctccttatggtataacaaaagtcacaatcggttttctgttatcctttatgtcataaaaatgttgcagaaattatctgttaatacttgaaagatttcctttcaaagaagaaaacgtaaagcctatacagttatcatcacattggcgtcagttaagaaaagttatccgtgtacagagggttttagaaggaagaataggaaggtttgctctagcttggaggcctttactcctttacagacgtgcagaaagaaatacctgtgattatttccttcagtccttttttctcagctgtgacatgtttattgtatttcgttggtaatgaatttttccaaagagtgttgatattttaggtttttcttttttttttaatttatcttaagcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagtggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttg

SEQ ID NO: 77867 - DNA, 2629 bp, Homo sapiens
aaatgtgaagataacccttaagacacctgcacttatatgagaagccttaaccaatcatattggaatttgaatatttggtgttagtaacttattttacctaacagacatgaaggtagcaccaggcattgtcctaatagttttacaataaaattgactgatttagttcttactataaccctgacaggtagatattgttagcactattttacagaggaggaatcagaaacacaaaaggctaaataacttccgcaaggccaaacagatctaagcattggttttaatatggatattgaaattgtttaaaatttaatttttacatatttaagagcattcagcctaccaaggccttatgccacttttgctaacataatttctttatcttcttttaatttccttaacatagctctcctaaaactatgggtagtacatggggttttgggggggtcaggtaaggaataattacattttgtgtgaatattcaaatgatgcttggtaaaaatctttgataacttcttaagtgattatttctctcctaaaattctttgaatataggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagtggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttg

SEQ ID NO: 77868 - DNA, 2335 bp, Homo sapiens
gtactggtgataactaagtcaaaaagactgctgccttgattagttgaaattggcttttctttgtttttctttgtacttgggatgatggaaacatcttctttataatgtacactctgggtgagaaaaactaaactgtaccatattttttgttttaaagctgttgcattttttttataatcattttgttctgtcctctgccttgatttgctatagaatgtctttcaatcttccttggccagacagatcatgtacagagcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggttcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagtggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttg

SEQ ID NO: 77869 - DNA, 2443 bp, Homo sapiens
ccggatccacttttcggcaaagtgacgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaaaaaaaaaaaaaaaaaaaaaaaaaaaaacggggggttttttttggggggggggaaaaaagggtaagaaagggggcccacgtggacaataagcggcgttagcccggagacccacagctctgttcgtgtacccaagaggggcgaacaaatatcggcgacggtcaccacccctataagagaggaggagcgcagactaatataagctttcgagaaaaagaccacgcgaggtataagcccggcgaatctaagcgatacggccgcggcaaaaaactgaatacacacaaagaaccaaaggcaacagaggaagaggagacaagagggagcagacgagataaac

SEQ ID NO: 77870 - DNA, 1991 bp, Homo sapiens
  misc_feature (1941)..(1941): n is a, c, g, or t
  misc_feature (1954)..(1954): n is a, c, g, or t
  misc_feature (1975)..(1975): n is a, c, g, or t
  misc_feature (1982)..(1982): n is a, c, g, or t
  misc_feature (1991)..(1991): n is a, c, g, or t
ccggatccacttttcggcaaagtgacgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaanagaaatcttggcnatcgaaaggtatttgattccnaatgcangggatgcan

SEQ ID NO: 77871 - DNA, 163 bp, Homo sapiens
tttttccccttcattttcattgtggctctttaaatattggggtttttcctaaaaaaaatttcaaatttacaaatatatgtgaaacacaggcttgtcaagtttttaactttaaaaaaattgtctagatgcttcagaatccatctgagtttgcacagtcagtaaa

SEQ ID NO: 77872 - DNA, 727 bp, Homo sapiens
gggacaaaatatgtagggaaacccaacaattgcctagtgatcttggatattagatataggatatggtgcattgaatgagaatagtttatgaatataggtaatagcgttaaaaaatctgaaacgtaatatactccatttcaataaaaaatatattattgtagtgatttctatgttgtatggaactttttattatatttattatattttcaatcattgcaggattatctgttaataaaatattaattttgcatacaattaaaaggtgttaatgtgtagcttacttgtttatagattaacctctgtttatatcttttaactcaattttatttagagttgaacatttctaataattgagatggttgaaacaacacctgttttgaattaaatttacttaaaaattctttttcttttaatgctttttttgtctcaagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtaagattttccttaagataatattatctgaattcagatattatctgaattactgtagttcactataaagagtttgtttctttattttggggaatggatgg

SEQ ID NO: 77873 - DNA, 1365 bp, Homo sapiens
gagtcgctgggtgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaaggtaggactgaggctctagaacttgcacctgtgcagggactgcaaaccagacctgggaggaccctttcagcagcccccactccaccctatcccaggacttcccagcgacccgccgttctgggagataccgggagcgtgatcagggggcggggccgtttccaaggcaaccgcttatttgcatagggtcccgtcctggccaacgagggcgccccaaatgttcaggacatagaagaaggggttaactggcccggatctcctcctcgccttccaagcccgctaagcactggggttatctacccattccccagaaggggagactgaggcagcccaccagccaaaggaggcgaccagactggggctgcgttttaccatttcagaagcggcttgagctggtctgagctataataataaacactggcggtggaggcgagggcgaccacagggctgaggtcagggctaggattccggtgtctctacgtaggttgcttgaatggggggcaccctggcatggacgctgctgttgccgctgctgctgcgggagtcagacagcctagaaccgtcgtgcaccgtgtcctccgcggatgtggactggaacgcggagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcct

SEQ ID NO: 77874 - DNA, 885 bp, Homo sapiens
gagtcgctgggtgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaaggttgcttgaatggggggcaccctggcatggacgctgctgttgccgctgctgctgcgggagtcagacagcctagaaccgtcgtgcaccgtgtcctccgcggatgtggactggaacgcggagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcct

SEQ ID NO: 77875 - DNA, 989 bp, Homo sapiens
gagtcgctgggtgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaagaagcggcttgagctggtctgagctataataataaacactggcggtggaggcgagggcgaccacagggctgaggtcagggctaggattccggtgtctctacgtaggttgcttgaatggggggcaccctggcatggacgctgctgttgccgctgctgctgcgggagtcagacagcctagaaccgtcgtgcaccgtgtcctccgcggatgtggactggaacgcggagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcct

SEQ ID NO: 77876 - DNA, 267 bp, Homo sapiens
tttagaagctaatgcctgcctctcagcctccttcaaattccaaagaaaataatttacaagttaatttcagtctcctgggtccgtttattcttcctaataatcatttactgcccttcaaaaaaattgtctacactttccatttccttcttcccctatcaagaacaggcataggctgggtgcggtggctcacacctgtaatcccagaactttgggaggccgaggtgggtggatcatgaggtcaggagatcgagaccatcctggataaca

SEQ ID NO: 77877 - DNA, 231 bp, Homo sapiens
gcctcccatggtgctgggattaaaggcgtgaaccactgcgcccggcctatttttagcctttctaaataattgttttaggtgtttctcttgaatagagcatatagttggttctttatgaacccaaatgaagatcttttccatttaataagtgaagtaagccctttcacatgtgttaagatgaatatgtttgctgtcaaccctgccagattattttatgctgtaattattata

SEQ ID NO: 77878 - DNA, 151 bp, Homo sapiens
tggcagatctgcggtggctccctcctttctgagtcattacacactcttctggatcattcctttcatttttccttttcctctcctctcccctattttcattcccctatcactgcaaagccaaaaccaaaacgtggaaggggacctagccgag

SEQ ID NO: 77879 - DNA, 450 bp, Homo sapiens
tatcattttatatcactttgattttgaactatataactgtattaccaatatatttttaaattaaggaaaccatagatggaatgtaaaatttttatctttattgaaacaatatttttgctaccggggttaataaaatcactatataccttgacttccatctggaatcttgttgtactgaaaacagggtcaattttagattggaggagttgggggagaggaagggtaggaagagaaatatattttgtcttccagcaaatacattagagacacagaaatgtttaaaatgttgtccctggcttccaggagctcaatgactagtagttggatcaatcagtatttaacgttcaatataatactaatgtactcagaatattattcttgcttattcatatatatacatatgatatttcaatttaagcaattataaacattgcaaatttttctatttat

SEQ ID NO: 77880 - DNA, 513 bp, Homo sapiens
ttacataacttccgtttctgctgaaattctctatgttgttgtctacttgtgttttacattttattacagaaaatttgaaacgtagcaagagaattatgtaacaaacccctgtggacccatcaaccagcttcaataattatccacattttgtcagcatgtttcatctaccccccacttccaccccatgcatagttttagtgaaggggagtgctggagtatttgtcagcaaatctcagacttcatatcatttcactgttaaatgcttcaatttgtgtttctaacagagaaggccccctttttataaaatgtgactaccatgccgttattacacccaccgaatgaacagtgacgaaggagttctttgaacttttagtgaattcagggtggaagtggtattgggatgaagaagctctggtctagatttatcccctttacccaaaacaatgggggaattcattgaaggggatcttggggcttaagctggcacttggcccaccccttacaagactttca

SEQ ID NO: 77881 - DNA, 788 bp, Homo sapiens
attatgtatctcccatgccagccttttttcttctttctcaaaattgtttaggctgctctgggtctattgcattatatatgaattttagataaactttgtgaatttagaaaaaggaaatgtcacctgggattttgatagaggttgcattaaatctatagatccatttggaaaatattgccaggctaacaacattaacctttataaacaatgaatagtcaaaggtttttttccatttttttcaaaatgttttctatagtttttgtgtatatatcttatacttaacttgataaacttatttttgatgtcatctcagatggaacattctgaattttttgttttagattgttaattgctagcatatagaaattcagaggattttatatatgttgaccttatatactggaagtttgttgaactcatttctaaattctaaccatatttgattagagccctttggacattttatacgtaagatcatgtcatatgccaacagacatagtttgacttcctttccatactggaagccttacatttatttttctagactaattgccatgtctatatcctccagtacaatgttaaaaacaagtgtcaagagtggaaatccttgtcttgtttctaatcttggagaaattagtgaacctttcagataacttatgatgatatgttggttggttttttatggatcccctttaaaaggaagacagttcccttatctgcctcatttgctgcatgtccttctcatagggagtttgagaattctcaagtgcctatgcatcttctgagat

SEQ ID NO: 77882 - DNA, 775 bp, Homo sapiens
gggggttctgttcttttgtatgccctgcatctttcttagtttactcccttattgtggttgaggaacagcttcccgataaaaggtacataagaagtgacatttttgctggccagcacggtggctcatgcctgtaatcccagcactttgggaggccgaggtgggtggatcacttgaggacaggagtttgagaccagcttggccaacatggtgaaacccccatctctaccaaaaataaaaaaacgagccgggcatagtggtgcatgcctgtagtcctagctacttgggaggctgaggcatgagaactgcttgcacctgggaggcggaagttgcagtgagctgagatcacaccactgcaccaccgcaacctgtcttaaaaaataaaaataaagaagtaacatttttgggagctggtgtgcctggaaacctttttattccacctacccttacactaattgaggctggagataacattgccttggaattttaaagatattgatctactttcttctaatatctgatgttatttgaggcattcagattctcagtcctttgtatgaaacttttaaaattttttctagttcaggtattctttgtagtgaaattcacaatggcataccctagtgcgggtctgtttttatatattgtgctgggcattggaaagccatggctttcagtttcaccaatgatttcctctgctgtttcttctgttctctttatggcatgcttattattcagatctgaggccttttgttctggtcttttctttcctactttc

SEQ ID NO: 77883 - DNA, 283 bp, Homo sapiens
gtttgtttatatttatactcatattttgctgtcaacttaaactatgcactgaaatatcttcttggaaagtatatcttatgtatttgattattttttattatgaagcagtagcaagttgttcttagcagttgtttgagtttatatggtaagtagccaagtaatttctttaaaagtcttatattcagttttgccttatactgtgaagctcatttaaagtcaacaacactatattttatagaaagtatttattttcctttattaagccataggaacaacagtggcc

SEQ ID NO: 77884 - DNA, 234 bp, Homo sapiens
gtgggttttcgatacatgccctctaccagattgaaggagtttctattttgagtttgctaatgaaaacatattgtttcattgttttaatcatcagaatttaatcttattaaaatattttctgcatttagtgatttttttttttcctctctgattccatttacatattttctactgctgaaccatcactggatttccagcataaatccaacttggccataattttgtttatatgtt

SEQ ID NO: 77885 - DNA, 414 bp, Homo sapiens
agataagggtgacaacttccaagctgttcacttgtcagatctggaaactagaagagcgctcagtttttgtatacatttctttttccctggcttctcctgagcctgaaatctttccaaatggtagttgtggtcccaagtccaagaagtgataagaaaaacaatgggaattaagattttagatagaacaaatggagtgaactgcaaggcagggccccaactttgtaactgcgtctctcttctcaaggtgttctgaatccaaacaggtccattgagggcagccctgtccttccaaagcccactgctgaatttgggtgatgctagtaacacagaacagtctcttatgctcaggtcaggcacatttacacacaggccaattctttagggctgactcttggaaacgcaattgaattgttc

SEQ ID NO: 77886 - DNA, 626 bp, Homo sapiens
  misc_feature (626)..(626): n is a, c, g, or t
attttacacattcagtagattagaagtagttatttaatctttggttagcataataaaagatcttctagggacattttttgcttgcagtggaaggctagttaaatgtgttcattagtcatgaatctgctttttctatagctgttggaaacgtagctcccctgtgatacagttgtagaatacagaaatctcgttttgctgttacggtacggtagtctacttactttcttccaaaccattaatgttatagttacctttaattgcgtaggtcctatcacccctcaattttaagactctaagcctggcattttatcttacaaaatgaaatataaagacttgtactcagagtatgtgtgtgttttccatatacccattcctaaagtagagaaagatgagggattcgccagaaactgatttctaataaattatccagaaactgaccccttctcacctcttctgttactgtcactgtggtttcagccacagcatcctttgctgcattgttaccttagtttcctgactgtatccttcctcacacctgtaatcctagcactttgggaggctgaggcagatggatcacctgaggtcaggagtttgagaccagactggccaacatggtaaaaccccgn

SEQ ID NO: 77887 - DNA, 314 bp, Homo sapiens
gtgttcttgcgaagtgagtctttcgggtctgtttgcaccccattggcggcgttgtggcacatgtctcactgtgcctctgactccccactcggcgctggagttcccaccccaaatgttgttctgcgagtgcatcttctggctgcttttcccctctgcaaactcctccatccactcccaggggtggacactaggctgcctccaactgcctgccactccagatgacaccaagtgcgtgtcctcccccacaccaccgtgcagcagcctgctgtgagaactgtcccaggagaggggttgctgggtcttgtggagacaca

SEQ ID NO: 77888 - DNA, 1266 bp, Homo sapiens
taatgctactgctaaaaactagtaaactaccagtaaactgtgaagacagaagtaactcctgtgatctatatgtttgtgcagatggtggagcttttctgctcctaaagcctgagaaatgcaaatgtggcttcgttaatgcaaatgcttcctacgccagactttatgaaactcctcctaaagttgaattcttatccaagtggacatatgttagggtgccattgtaattcaggtagagtgtcagagtggtggctggcaccaacggtagatgttctcaacattagcgttattcaggtaagactacaacaatgatgaacatgtcaaaactttcctttaaaaggaacaatcagaaaaactctttaacaaatgtttttctttccgtagtattttaattaaaatttttaaaattttaaaatttactaaatttatgaacgtttttatcccacttgagatgaatacttatttatagtccctgtcccatgaagcttctgtggatttgctttgtttgtcatttgtggtatgtttgataacaaaaatattagtggcacaaaagcagttatattgaatgcttttgttttagagaaaatttcactctgtactagaaaatgtagatgatgtgagtcaaagttcattaatatttacctgaaaatttgtgtataaaggtaaccttggggcagtttattttgcttagacccctcagcttcttgatagagtgaggtgagggcatatgtaagtcagtaaactattctgttagtaaagtcaaaggcgtaatctaaattaattatgcttttaactaacacagaagaaatcatgtgacctcattctcaaagctcgtaacatccacctggccaatcttaagatgtggatagagttcttttttttcttttttcaatttttacaataatttttgacacattggaagctgtgcatgtttatggggggcacaatttggatgtttccaatacatgtatatgttgtgtaatgatcaaatcggagtacttagcatatctatcatctcgtgcatttatcatttctttgtggcgagaacatttaaaaatcctattttctagctattttgtaatatacactaccttactgttgcgaaccatagtcaccctactgtgcaatagaacacctgaacttattcctcctatctagttgtaactttgtacccattgaccccccttcccttccttccactctcccctccccagtctctggtaaccactgttctgttccctatgagataaaactttttttgtcttccat

SEQ ID NO: 77889 - DNA, 395 bp, Homo sapiens
tgtatagagtgacaatgcttttactagccaatggttaaactaatacaccacaacttaattattcaataatacattattttattcactaaaataaatatagatttgtaaaatagttcatgtatctgctaggcctgatatttatcacatctacagataacatttgggatgcatatttttcagagtctacctaaaataactctgagggcgtcatggaccatgaactactgtaccatatctgtaatacttggatggttactaagaataaagaaaatgaccacagggaattgggaattgtctttttaccatttataaagattccacgttatcaggcacatttcatgttttcttggcttttttttttttgacggagtttcactcttgttgcccaggctaga

SEQ ID NO: 77890 - DNA, 799 bp, Homo sapiens
tccttagcattgtttgagatcacacatattgctacaagtagatctggcgtatttattttcactaacataaatattttaccatatgaatatatcataatttatttggccattcttttcttgatagatacctaggttggttcttttattattgctattattgttatttaatcactgtgtttattatttacaatgttacttgaaatatttgtgttcttttcctctgtgcacatagcaagagttttctgagggaaaaaaggctaaaatggtatcattaggttaagataattgcatcttcaactattagatattgccaaagtatttaccaaaatgattgtatcaattaacacatctgcacaaaggcttcccattcccaaagtgctggtccttgtcagcacttgattctgccaaatatgtaattttttttggtcaatctgatggttactaaatgatacttaattattgttttattttgcctttccctgattactaacaagcctgagtatcttttcacatgtttgtggatcaagtaggtttctagtcatgcatattgtttgttcatctttttgcctattttaaattaagttttgtttttctatattaatacataagtatatttacatatactggatattaattctttataattaaagccattgtaaataccatttcatggtctatgactcctaatttttcattatgtttatgctgctttgttgataagagaattttgtatccttcatgatttgtgtttttcatatgttgttgaataaacattcctttaatctaagatcataaaata

SEQ ID NO: 77891 - DNA, 451 bp, Homo sapiens
gagggcaggtgggagaggggagatcttagcaacagcctcaacctgtctgtctttctgtttctatttggaggctcctgcttccacttccagtaggtttcactaactcctcttgcctgaagttgtcaccagggttgagtgtgtgtttttgagtgtgtgtttggcacacagagggcagaagatacatgtttcttagtctcacaactcatggcaaggatattggagaagtaagagatgatgtgacaaggggaggggttggaactagcctgggggctggctttgtaggtgaggactcccagttccgctgtctctagtcctggaactttgtggtagaggttacggggtcacagcaattctgttcatctggtgggccccaggcagggttccagctgccccctttcccagcaagaaacccactgacctgccagagttggttggtccacatgaatttcct

SEQ ID NO: 77892 - DNA, 508 bp, Homo sapiens
tttagacagggtctcgctctatcacgaaagctagggtacagtggcttgattacagctcactgcagccttgaactcctgggctcaagtgatcctcccaccacagcttcccaatagaaatggggtcttgctatgttgcccaggctggtcgtgaactcctgggctcaaggaatcctcctgccttagcctattaaaatgctgggattacaggtgtgagccaccacgcccagccaagggtagtttttgattaatcagtttatgtaaggactgcagccaagtcctgaacctacaggctgccacccaataacctgagtgacagtgagcgactgggcttactgccttccttctttttattattcttagaagatcctaagtcttacaagaaccattctcgcctacatttccactcagataacttcaacagcccaagtcaaggagaaatgaaatgttgcaagtagttctatccttggataacagtaatccaatgcacttttcaactcctcccccattt

SEQ ID NO: 77893 - DNA, 684 bp, Homo sapiens
aaaatatttgtgaagaggacaaagtggtatatggcatctcctttgatgctttcatataaaaggaagttgcagagagatgactccggggacactattaattttgtcttcacacaatcagtccataatatgcaaagttgtacatactatacatacagtacttaacggggtatcaagtttattctcttagcactgagcaggatgttctgagatgtgcaaaccttttgctaattcatctgtatgatgattaggttactggttggagaaatttcctcaatatggtatactgtgctttgatatcaggtgctaataatttgctgcaaacaggacctagagaattacttttaaagacaaccttttgatctttccagattaaaacatacaaaagaataggttacactcttgtaaggaaaaagcttacagaacttactaactacagctgtctgtgccatagcctggttggtcaggtggcctattgggaagtatataagtgccagtagaactgagttcatatgtctcagaagtagtaattgtttctattacatggataccatatggaccagaatgttcatacagccaggtataagctccacaaagacagagattagtgtttgtctgaggtaccgctgtgccccagtacttagaaaagtacctgacatttataaagcactaccatattgaagaata

SEQ ID NO: 77894 - DNA, 414 bp, Homo sapiens
tgagatgaagtcttgctctgtcgcccaggctggagtgtagtggcacgatctcagctcactgcaacctccgactcccgggttcaagcaattctcttgtctctgcctcctgagtagctggaattacaggcacacaccaccatgcctggctaatttttgtatttttagtagagacgcggtttcaccttggcctcccaaagtgctgggattacaggcatgagccactgtgcctggccgagatggggtttctccatgttggtcaggctggtctggaactcccaacctcaggtgatctgcccgcctcagcctcccaaactgctaggattacaggtgtgagccaccacacccggccttacaggtcaggattttcttcattatttctcccaacaagcctgcatttcccagcctgtgctgatc

SEQ ID NO: 77895 - DNA, 229 bp, Homo sapiens
gtggtaacttttttaaaaaacataaataccatacaattcatccttttaaagtgtgtaattcagtggtttttggtatattcagtgttgcacagtcatcaccactaattccagaatattttcatcactcccacggctgtatctcccatttctctcttccctgcagatcctggcaaccgctgatctactttctgtctcttacagacttatctgttctggacatttcacataa

SEQ ID NO: 77896 - DNA, 466 bp, Homo sapiens
gctcgtttgtgtggcaggactgtggggatttggacggacatagcctcgtgttcagcccgggtctcatgttcccagacctggaaggccttcccgccttcttggaccatcctccggtgacggtgtcctgatgccgtaggtttctggtttgtctgttttgtactaaaacactcctggttgtcagcccttctcccacgtgtgttggaggccgggactgtagccgcagctgatctaagttcaccagcgggagctggtggctgtcctgagctcagctgacaccccatctttgaaaatcagccatctttggagggcagggaggagatcaggaaagatagctaatggatgccaggcctaatacctaggtgatgggatgctctgtgcagcaatccagcatggcacacgtttacctatggaacacacctgcacatcctgcacgtgtacccctgaacttaaaagttggaaataaaaa

SEQ ID NO: 77897 - DNA, 389 bp, Homo sapiens
gcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagttcgataga

SEQ ID NO: 77898 - DNA, 3153 bp, Homo sapiens
cgctgctggtacgcgccgggattttgggatacccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccgcctgtcagcttatccagctctggaaggggttctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggccctgcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagtcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaaaa

SEQ ID NO: 77899 - DNA, 2597 bp, Homo sapiens
cgctgctggtacgcgccgggattttgggatacccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccgcctgtcagcttatccagctctggaaggggttctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggccctgcacaaaggggcgcctagtaaaccttaaccaacttggttttttgcttcacccagcaattaaaagtcccaagctgaggtagtttcagtccatcacaaataaaatatatgtttgaggaaagtataaaaaacctcgaggtggggccccggtccccaattcggccctttagggggccgttttacaatttaactggccggccgtttaccaaccgcgtgaactgggaaaacccgggggttacccaactaaatggctctgcaaaaatacccctttttgcgactg

SEQ ID NO: 77900 - DNA, 420 bp, Homo sapiens
agttggagggcagaaaggagttagaggcatgatccttttcagatagaaacttttcaggaaaagaaaatagtccagttgtttaaaaaaccctggattttaaaaagagcttagagagtcggcctaagtaattggtgcaagacagtttaaacagaaacagggagtctcacagcaagttggctggaggagctgactcatacattgcaacataattatttcccaaataacatgcaaacaagagtgggctcaagctttctggtctctctctccctaacaagataaattagaaagaaataaagtcaaatccaggaagacttcatagaggtaaggcctggaactggttcttaaagaaccactagaattcagagaagcaaaaggagtaagagtgggcataggacttacaaagcaattcatttggagaag

SEQ ID NO: 77901 - DNA, 1307 bp, Homo sapiens
cggcagtgactttgtgttccaggcccgagtgctgggccaccaccaccaggcccaggagacccgctatgaggtgcgcatccagctcgtctacaagaaccgctcgccactgcgggcacgcgagtacgtgtgggcgccaggccactgcccctgcccgatgctggcaccccaccgggactacctgatggctgtccagcgtcttgtcagccccgacggcacacaggaccagctgctgctgccccacgccggctacgcccggccctggagccctgcggaggacagccgcatacgcctgactgcccggcgctgtcctggctgagcccctgcaggagccccggccacacacagcaagaaagatacatctgaccagcctcaacgtcaacgtatttcccctctcaccctggcttccaggcagctctgaaatacgtcccacctgtgcagctatgtgactccctcccacacacgcttaagacacctctgcatgcagtcaaagccactgtcacaagccggcaggcactggtgaggaggcactaaggagactctgacttttatttcgcctctctccttggctgccaggaagctcatagctatttatactcagaaagtttaacgctgctttctttctctttgcgcgcgtcacacttgcttggagacactgtcatgaacgagcatgacaccctgctgccctgggtacccagaagatcatctgtttacttcccagacactgtgctgtctctgctctctgctactcacacacaccctcatgtgtgaagggcagagacactgtcacaaacaggcatgccccttagaagacatgcctaaccaggcactgtaacgtaccaacgtaccaatttccccttttcccctggctaccaggaaactcggagacaatcttttcagcctcagcatttctggctggatttccacccatcaacacgtgcttgctcctcctttttttttttttctgaggtagacccttgctctgtcacctaggctgaagtgcggtggtgcaatcatggctcactgcagcctcaaattcctgggctcaagcgatcctcccacctcagcctccacagcagctggaactccaggtgtgaatcaccatgcccggctaacttttaaattttttgtagagatggggtcttgctacgttgcccacactgctctccaactactggcctcaaacgatcctcctgcctcggcctcccaaagcactggaatttcaggcatgcactatcgtactggctgttcaccccccttttattcctctttaatttttacaagcactttttaaaaaaaaattttacttt

SEQ ID NO: 77902 - DNA, 693 bp, Homo sapiens
cggcagtgactttgtgttccaggcccgagtgctgggccaccaccaccaggcccaggagacccgctatgaggtgcgcatccagctcgtctacaagaaccgctcgccactgcgggcacgcgagtacgtgtgggcgccaggccactgcccctgcccgatgctggcaccccaccgggactacctgatggctgtccagcgtcttgtcagccccgacggcacacaggaccagctgctgctgccccacgccggctacgcccggccctggagccctgcggaggacagccgcatacgcctgactgcccggcgctgtcctggctgagcccctgcaggagccccggccacacacagcaagaaagatacatctgaccagcctcaacgtcaacgtatttcccctctcaccctggcttccaggcagctctgaaatacgtcccacctgtgcagctatgtgactccctcccacacacgcttaagacacctctgcatgcagtcaaagccactgtcacaagccggcaggcactgagatggggtcttgctacgttgcccacactgctctccaactactggcctcaaacgatcctcctgcctcggcctcccaaagcactggaatttcaggcatgcactatcgtactggctgttcaccccccttttattcctctttaatttttacaagcactttttaaaaaaaaattttacttt

SEQ ID NO: 77903 - DNA, 522 bp, Homo sapiens
gtagagatagggtctagctatgttgcccaggctggtctcaaactcctggcctcaagtgatcctcacacctcagcctcccaaagtgttgggaatacaggcatgaacactgtgccctgccaactttttatatcttaattttggaacataccttcacgtatagtatcacgtttgatccacctaacaacttcgagaaatgaacaagatagatgctattatccacttttcatgacttaaaagatacagaaggaagtctaggtcatggaacatcttgccctgggtcacacaggtagttaacagtggagtgaggactgtcccacatcctcaagtcccttgccaggtgcatgtcccttaaaccaccctgcctaatgccggcaaggcccagagggcagcacttggcccagttgcactgggaaagaaaaggggctgatgtttctttttctttatgaaatatttggggtttttggctcttattgcaggaagcaagaaatgagaatctttcatttccttacccagccttcctgt

SEQ ID NO: 77904 - DNA, 565 bp, Homo sapiens
  misc_feature (419)..(419): n is a, c, g, or t
  misc_feature (426)..(426): n is a, c, g, or t
  misc_feature (482)..(482): n is a, c, g, or t
  misc_feature (515)..(515): n is a, c, g, or t
  misc_feature (548)..(548): n is a, c, g, or t
  misc_feature (562)..(562): n is a, c, g, or t
caagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgcctagaaagggacggcctctcccctcctacctgccaccgctggggaggcacagagctcgccagcgtccctggaagtcccctcaggaaatggaaagtggagtgcccttggtctggtagcaccatgtggggagggacccagctnggcgcangcccctggtgggccttttagaatccagacctccctgccggaatgccccgaaggcgngaggccgggctgtgctgcaggaaacccaatctncagatgccaaaggaacttgaaggggaagctganaaatcggctgtgtnccc

SEQ ID NO: 77905 - DNA, 428 bp, Homo sapiens
gccaccattatgctgtacctccaagcataatggtacatccacacacaccaaggcacctcgctcatgcaaggtgtgtgtcctctaacaaagtttcacactctaaacccagataacttttcaaacccaagttctgttgattcccctactttgagtgctccatagatgctcatttgtctactaaacactgccccaggcaattaaatattccaaagtgaccagcagaatttttatgttaattctgacattgcgttgttagtacaagtgtttttcccccttcaaatttatgtctttgttactgataaatgtaactgataatgcgtttttcagctgtgttgccaagcatatttatataaaaatatactcagattgttttcagaatttgacaaagatgatagcaataatgataatcttatttgttttataccaat

SEQ ID NO: 77906 - DNA, 600 bp, Homo sapiens
tacaagcagtgatggttcttctgccagcctgccgccatgggattgctctgtataagaagacaggtgcattctggaaacttgaatcactaaggggaggagcttcaattttgatcccagatatgctttaaactgtcttcagcttgtaggtggggttctgctggggacctgcccctatctgcctaggcatttggctgcctcctgtcactatcactaccaacatgtaatagctcaccaaaatgttgtatttcaactgggcagataaaacagatgctaataacctcaagagaagaatgttccttacagaagaaggaatatttcccaactcatttaatgaggccaacattattctgataccaaaactatacaaaagcattacaaggaaagagaactacagaccattattcctgatgtacaggccctgtcttcttccaagtcttttgtcttcagtggtgtctgcatgaagtggaatcattttcccaagcctgccaaatcaagaataaactcatctaagaagggtggagaagcctatctgaagggatggttacccatattgtgaaaaaactgtaaatgctttcaattaaatgatgatataatatatca

SEQ ID NO: 77907 - DNA, 424 bp, Homo sapiens
atacaatatagacacataataagaaaggtcttcaaatatataatcacagcagagtcaaatctgtgaatcaaaactattctttatgtgcataattaaccatttcaaagaagagttgggaaaaatatttaaggatatgaaacagttatgccattttcaatgttcatttttaattccacctcgtaaaatacatctaaaatagtagaaaagtttaaagtctgttaaattatcctggagaataggaaaatagacgacttgccaggtttggcctaggagaaaatgcctagtagccctgtttatttttttccacatattctaaaaaaataaggaagcattgcctaactttcgtacatttcatataaatataaggtaacattgtatcttttgtccatttccatagaggttaagagaaaaaatcaagtttaaa

SEQ ID NO: 77908 - DNA, 398 bp, Homo sapiens
ttacactatttaatctatctttcatgtctctgaacctctctttaatactttccatttaaaaatctctctgtattatactctggctatttttgcagatccagctctgtgttcactaattatcttctcagatgtatctaattgagtgttatgtctgttcattaaatttttactttcaattattttatttttgatttctataaattcttttttaaatattagctctacattttagaattccttgatttctgacattttggatccttcctttatttctttaaatatgttacagatgtgtattttatattctatgcaaatatctgaaatttttcgtggatctcattttgtggtctattttttttgcactccagcctgggtgacagagggagactccatctcaa

SEQ ID NO: 77909 - DNA, 413 bp, Homo sapiens
cttaagggcagcctcgaccgcctcctgtcctcctgcctccctccactcgtttctggcacactggcaagtgtgagcattgacaagaatgaccgggctaaggagacctgtcctgtttcaagacagagacattctggctgggtgcagtggctcacacctgtaatcccagcaccttgggaggctgaggcaggtggatcacctgaggtcagaagttcaagatcagcctggccaacatggtgaaaccccatctctactaaaaatacaaaaagtggccgggcatggtggcatgtgcctgtaatccctgctactcaggaggcgtggcaggagaattgcttgaatccaggaggtgaatgttgcagtgagctgagatcacgccaaggcactccagcctgggtgacagagcgagactctgtctc

SEQ ID NO: 77910 - DNA, 773 bp, Homo sapiens
gtgacagcctcagctgtgacaaaggagagaaaacagaaagacctgggaaagtgcaaggatgaagcaattaagtttgagaaatgtgatgtgaggtttaggaaaggtggattttagccccagcagacttttagctggacacggacctaataccttgagacttcattgttcccattaaagaaaaaattatcttctgactttctaggggtttgggggtcccagatatcaaaagatttaaaccacttaggaggtttccattggaaggagaagactgtctttagcccactgcatcccctcaagccatcccaagctttctctgtgccagggactggacgcacgctaaaatacgaacctgtgtggacttctttcttaggagcctttgcaccagcacaagaaagagacagagacagtgatggcgagactcaagcacgcatatcttgatggactccaaaatgctcttcctaattccttctctgtggctcattcttcatcctctatttgcattggtatgccaattcattgctgacacttcagtggatgacttggaagtgatttttaaaaaattattacatcaatgtcagtatgacaaactttgccagttcaaatgtgtactgccttggaagtggcattgcatgaggaaaaattattttctaacaaaaataggaataaaattcaaaattatatataaaaatctaaaatgaaaacgacagaacctgtagtaacctctgcatgatgtaaaggtggttgcaataaaaatcgcgaggaaaactgaaaag

SEQ ID NO: 77911 - DNA, 248 bp, Homo sapiens
ggttgcagtgagccgagatcgtgccactgcactccagtctggtgacagagcaagactccgtctcaaagacaaaacaaaacaaaagccccctgcattgctgtgtggaaaacgtggtgatgccccccacagaataggagactaagcagagagtcactaaaggataaccacccatcgagtgtagaggctattcagatgttatagcacttagcaataagtgaaagacacaggactggccaggcgcggcggct

SEQ ID NO: 77912 - DNA, 635 bp, Homo sapiens
  misc_feature (617)..(617): n is a, c, g, or t
  misc_feature (619)..(619): n is a, c, g, or t
ccaataatttttgagaagtgaatggcctcattattatcaagtagtttccaagatttagtttgtcattgttttatagagccagaagcctgaaaacctaagtcctagttcagactatactactatttgtggcatagttctttgtgggaattatttttactttgcctctctgtgcttttcctttctaagaaattgagtaataatacttaactagtaaatgtttaatattatggtaaaataatagttgtcaagtactttgaagacttaaatgatatgtatattaacttttttactctcattcattttgaaaagtatcagagcctcagattaagagtgattggatagtttttactttgttgcattttctgtgtgaaattatgtagctcataagctattatcttgtatatgtgtgtttacgtgagtaaagtgattatgcttatgtctattttagttactgtgtgtgaatgtaattttttaatttttttgaatggagccctccgcctcccaggagaatcgcttgaacccaggaggcaggataatcgcttgaacctggtaggcaaaggctgcaatgagccgagattgcaccactgcactccagccagggctggagcgagactctnantaaaaacaaaaaaaaa

SEQ ID NO: 77913 - DNA, 328 bp, Homo sapiens
atatgtatttattcaagtgcttaggaaaattatcaattcaacaaactacaattttgttttagacatgaataactgaaggtggtgggaggagggtagagagatgttggtcaaaggatacaaaattttcattagataagaggactaagttcaagagatctgttatgcaacctggtgactatgtagttgataacaatatattacattcttgaaaaatgctaagagagtagattttaagtgtattcaccacaaaaatgataactatgtatggtaatgcaaatgtcgattagctttatttagccattgcacaatgtatatctatttcagaaca

SEQ ID NO: 77914 - DNA, 348 bp, Homo sapiens
  misc_feature (15)..(15): n is a, c, g, or t
  misc_feature (23)..(23): n is a, c, g, or t
aggccggtacggccngagagtanggatccgccgccgccggccgcccgccggccgccacgaccccagtccccggcgggcgggcggaggaggcgaccgccgcgcgctgctgcactcatcctgccgccgccgcgatgcgcagaggggccgagccgcctgggggccgccgccgccgccgcgccgcaccatgaagctccgcagcaaggcggcggcgctgctcttgctcgcgctggccgcgctgctgctggcgctgctgtccctgcgcgctggccgcgctgagcccccagcgctgcccgcgcgccccgcgtccgccccgcagcgccaccccgcgcctgtccccgcgcgctggcc

SEQ ID NO: 77915 - DNA, 303 bp, Homo sapiens
tcctctgtagttcaggtttgcaaattttggcaggtcacatgacttatgtgagatccagtgttcatattttgaatggcaataataatctttgtcaatatacccccgcaaggtgacaatgagaaacttcagcttctgaatgacatgtattatcattgccaaatgataatattttttggaatatgccttgataatctgtcataatttttataatgagccatcttataactatcctgttactgcattaacaaggattatacaagctgctgtaacaaataagtcccaaaatttcagtggcccaacaca

SEQ ID NO: 77916 - DNA, 150 bp, Homo sapiens
ggagaggagaaccgctccttccttggatgccaccactgtcactgccaactctgctgaccgtcaccagcagtgcagcccccaacagtacccaacttgcccccctccatggctaatcctgccctcaatagcgccccccacctccactccccc

SEQ ID NO: 77917 - DNA, 477 bp, Homo sapiens
tcatataagctttcaaagttgatgaatgtaaggtgtcttgtttcaaggtagatgttttcacatacagatgtcttaccagagatttttcattgagcaaatatttcatattttatttaatagattttctattatttatcttagtgattttattctgctgaatgaaaaattttcattactgactagccatcttggtattaaaatcatttcagttggtagcaagactatttttcaaaaaatctttcttctgatttccagatcaattttaaaaggaacatcttgaattatgcagatcaactctatatctgagtgtgtgaaattgatagattctgaaatatcatgaaatctgagttgcattgttaaacagtaacattagtggagtggcttcaattgactggagtacaaagttgaggaatgtttattcggaggcaggaagaccatgaagtataaagcccatgtttgctcctatattttgtattt

SEQ ID NO: 77918 - DNA, 539 bp, Homo sapiens
tttgaatctttagaattttatttataaaacttcaaaaaatagacttttactactgtcatgcctctggcttcagatgggtgacattcaagaagaggaccaaagttgtagaccttagttacaacaatgatccagaagaaagataaattattttcagataagagctgacaaactatgattaatgcttctctgatgattgttagcatttatgtaataattctcagggtgtgagctttaaacattttaaaattaattttcaatctgagaattgattaaaatagacaaaaacaaacaaacaaacaaacccaagaagtcttagaggcaaggctctggtcaggaaacaaaaggttagtgctctaaaaatccttctcattttttattaaaataattttcagttctataagttgcattgaaaaaaatcaagcatactcactaaacattcttgtgctgaatattcacaaataataaacagatttctagttaaacatgacagatgaaacacatgtgtttatcaacactgcttctctaaacttcactgagtt

SEQ ID NO: 77919 - DNA, 566 bp, Homo sapiens
gggttagttgtcagtatctttcccagttgttccgccccctacccccgcctcccgcaccgcgcccctctccggctgccctctccgcgtggggcaaggctccgagggcagcattcagtagccatttagctttggaaggagaggtgattcgaatggcccggctcctcctgtcaccatgctaggcactttggccgcgcaggtgctgacctgaacctggttcatccctttctgaccaaaacttgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagagaaaaaaaattg

SEQ ID NO: 77920 - DNA, 1314 bp, Homo sapiens
atgtgggtggaacggggaagctggagcagatttttggaggaaagcaaaactggggactttcaggactaggggcctgggtctcagaagaatgggaaaggacgagaaaggagtctaaataagaaccctgctattagcattgtttggttttcttttcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagagaaaaaaaattg

SEQ ID NO: 77921 - DNA, 1354 bp, Homo sapiens
gggttagttgtcagtatctttcccagttgttccgccccctacccccgcctcccgcaccgcgcccctctccggctgccctctccgcgtggggcaaggctccgagggcagcattcagtagccatttagctttggaaggagaggtgattcgaatggcccggctcctcctgtcaccatgctaggcactttggccgcgcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagagaaaaaaaattg

SEQ ID NO: 77922 - DNA, 401 bp, Homo sapiens
tggatgaatgaaagatacatggatggattgatggaggatagatggatgaatggatggatgaaagagtgaatgtgttgcacggatgagtggatccattaatcaatggaagagtagatgtttgcctggatgaatgtagagtttgactctccttaaaatccttagagttttctttaagggtcctccaccctgaggcttaccctggccacccaaatgctatggcaagaacctaaattcttaccccaattccacttcctcttcagatacccaatgataaaatgagatattaaagggaagatcactttgcaactgatcaagtgctacaaaaatttcagcctgaggcaggaccgttcaggacagtctaactgcctttgttgtccctctgaacagtggatatattttca

SEQ ID NO: 77923 - DNA, 1065 bp, Homo sapiens
gtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgctggcagtttttcctttttgtccaccaccctgctctttttaataattgtacataatccgtgtatttgttttacctgctcatcttctaaactggcgagccctatagttcgttctcattgttagattttgccttttacaagtgtccccaacctgcaataaacttttccctcttgaaaaaaagtaatcagggatgggcaaaggtttctgt

SEQ ID NO: 77924 - DNA, 1031 bp, Homo sapiens
gtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgctggcagtttttcctttttgtccaccaccctgctctttttaataattgtacataatccgtgtatttgttttacctgctcatcttctaaactggcgagccctatagttcgttctcattgttagattttgccttttacaagtgtccccaacctgcaataaacttttccctcttga

SEQ ID NO: 77925 - DNA, 1009 bp, Homo sapiens
gtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgcatttcatctggagcagggcaggtaaccacaggaggaggcatgcccgaggcagccaggactgggcgggaaggtgctccctggatatactctgtgaaccttctggaaggctgccgccagggtgtctttcacactcgacaccctgctccgacgaacaatggtacataagcacgtctagctgttcgacttgtcatgatgattcctccactggcgacccatacagttcgttctcaatataggtttaccctgtggggatcgcatgta

SEQ ID NO: 77926 - DNA, 438 bp, Homo sapiens
agacacccatggaattagtagttttcaaggtggctttgaatagagcattttcaacaaagaacagtaagtttttagagaatacaagactgaggaaaaggactttgaatctgtagccgtagtaaattttggaagggcaaatcaatatggcgggtagaggctagttggtgaagcttattaacacagattcttttccaggctaaagttgtcttcagtggttaacctttgtttctcctagtagagaggtgggcaggataccttttgtctttgcaaatctatgtcttgatttaggcaagtggaaggcagagaggtttcttgcatctgctccttcaaaactaccttcagtagaacaatccttcctattttggggtagcatattctggtttcccagaacatacttcagtcaaaacaacatatcacagcagattaaatacagagcca

SEQ ID NO: 77927 - DNA, 1027 bp, Homo sapiens
aaaaatccatcacagtttgcagcttttaaaagaaaaataagagattatgtactctgcgcacgtacacatctacaattggtttttaattcgtgttattgcacacactgtagaagacattgtcatcagacaatggttaatttctcgattgattcatttatttgacatctaagctgtcatagtaacttagtgtttatttgcatttaatactgagtaggtgcccatataatttggggtacaaaggtataatagcatttacacagtccattccttaagggtccagatatcctgactgtttgcctactggtcttctaccctttctacctaatgtgtctactgggtcttctggtatttcttgggggaagcgcagtttgattggtcttacataaatattttgactgtggtcatgggactcttggcatttaagtagaagctagtgttagtgtgttgccaggcaggagctaggtgatgagtccctgactataggtgctaagagcgtaggtgtgacccattatccagttttatgttgtgtggagcaactccggtagaattggccatgttcttaattctcctttgctttacggtttttagacagctgaggcagagtggtatgattaggcttagttatgtatcttgttggatgctcaaggagctatatacattactaaaaattctaagatttctattgcttaaatttacttctcccatttcattttgagaattaacatgtttgccatttatcataatttttaaaaatcagtttatctgtattaagtacaatggtgaaaagttatttttgaaattaaccttgggttaaattttctaatgagagcatactattaagtgaagtaaccagccaaatgaaaaacatgtaagcattttggtcatttgttttcaaaagatatgttacttacgggctcttctgcaagggggatttctttttgtttctatgctatagagtggagttgtatgaagaggttagattctaaagtcgatgcatagaatgaaaatcacatgtagtaaaaaaaaa

SEQ ID NO: 77928 - DNA, 1604 bp, Homo sapiens
aggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagaggaaccagcttcagaacagttttagataaagctgtgcaagcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggcagtataatatgccatatccaccagtgtatcaccagagtctggacaggctccataccccgggaacccagagcttaataacccttccctcaggccccacagaagtcttactatcacaggagtatatgtctggttcgaaggtcagtgattagatcgagggaagaaataccacctgtatagtgttctaactctacgcctggtaggtatgagctcccggagaagcaggataatggttacgtagaaggccctccatgttacacattgaaaggcggggcacaagatagatgtgttgacaagaagacgaccggtgagagactacagaggagaacagaagggagagcactgggatgagcatcaaaaacaagtgttagtaatttcaaaga

SEQ ID NO: 77929 - DNA, 848 bp, Homo sapiens
aggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagaggaaccagcttcagaacagttttagataaagctgtgcaagcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtcttgctgtggaagggtaccgg

SEQ ID NO: 77930 - DNA, 949 bp, Homo sapiens
aggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagaggaaccagcttcagaacagttttagataaagctgtgcaagcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtttttgcacggaagacagaaagagatgaactcttaaagcctgagacctgggaggaagctggagaaaagatgccctctgaatctttgtgtttggctgcccaggctcgcctttacaccagaagga

SEQ ID NO: 77931 - DNA, 918 bp, Homo sapiens
aggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagaggaaccagcttcagaacagttttagataaagctgtgcaagcagatggacaagtgaaagaatgttaccagtctcatcgtgacaccatcgtgcttttgtgtaagccagagcctgagctgaatgctgccatcccttctgctaatccagcaaagaccatgcagggcagtgaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtctcacatcaggaattttcaaaaatgaaacaatctaataatgaagctaacttaagagaagaagttttgaagaatttagctactgcatatgacaactttgttgaacttgtagctaatttgaaggaaggcacaaagttttacaatgagttgactgaaatcctggtcaggttccagaacaaatgcagtgatatagtctttgctggtgggacgcttccccccagctcctcgaagcgacccaatgagtcgtccgagcacccccccgtgattgatgtgcctcctggtctg

SEQ ID NO: 77932 - DNA, 108 bp, Homo sapiens
gagggaggggacgatgagtggtttggtgtacaccaagcttgtccaacccacggcccaggatggctttgaatgtggcccaacacaaataaacttcttaaacattccgta

SEQ ID NO: 77933 - DNA, 346 bp, Homo sapiens
gggctttccaagctatgcaaagaacccctgaaatgaggagctactgagagcctttttgcaaaagaggaacatgactctccttacactgagaaggataatctggctgctctataaagactagaccaagtagggcaaaaatcacaccaagagaccagtttaaggctactgcattgatccaaagaagtgagagtgatttagactagggtggtagcaatagaagtagtgagaagtggcccaactgaagacgcattttgatggtagggacaagggagtttggtgaggtagtaggtatggggcagagaaaaagtcaagtcaccacagtgccagcggtttttgatgactcaag

SEQ ID NO: 77934 - DNA, 854 bp, Homo sapiens
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggattctccttttacaaatgcaggaatgggatctaatctaaatctgttaggtgaaattgagtgtgatgccagcataatggatggaaaatccttaaattttggagcagttggagcactgagtggtatgtgggcattatgacctactatctttggaaaatcatgcacgtgaccatttcatgccttctaaagatgattacagtctttttcaccatttctgcttggaatagtgtttaaaacaaatgttctttttttattgaatttaaaacatacagtcttagttataagtagtttttggtttgaatttgatcattctcctgtatcccttgaagagattaaagacatttaagacatgatttagaatattaattttacaatttgaaatacacactatattttttgttgtaaaaaatttcaggtaatataaataaaatttacctttgatcctccaaaaga

SEQ ID NO: 77935 - DNA, 2356 bp, Homo sapiens
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagtggtagtgctccatttaataacagtaataagtaataaagtgtttttatttgttaaccagtttaagtggatcctgtggtaacttaaactgttgttctcatcccttatatggggcatttttctttaacaaagaatggtttcagtgaaacaatctagcagagaattaatgtcagaacctttttaaataatagtctgattgatacagtttgtacttatttcatcaagcttttctaagcttaaatattgcatagcttcgagctgtatggactatattatgaaagaatatgtaaagagaacatacagtaatgcacagtccttaatttgtgtataatggaaagttatttacaatataacactgtaaataagaaagcaaagtttatgggaaaattcaatattatctttgtttttgtttaaatatatttttaagataaaggcacaaaaataaaagaagcgtattactgggtatagtatgtgactcctcttctcagactaataaattatcttttgaatccttaaataga

SEQ ID NO: 77936 - DNA, 2287 bp, Homo sapiens
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagtggtagtgctccatttaataacagtaataagtaataaagtgtttttatttgttaaccagtttaagtggatcctgtggtaacttaaactgttgttctcatcccttatatggggcatttttctttaacaaagaatggtttcagtgaaacaatctagcagagaattaatgtcagaacctttttaaataatagtctgattgatacagtttgtacttatttcatcaagcttttctaagcttaaatattgcatagcttcgagctgtatggactatattatgaaagaatatgtaaagagaacatacagtaatgcacagtccttaatttgtgtataatggaaagttatttacaatataacactgtaaataagaaagcaaagtttatgggaaaattcaatattatctttgtttttgtttaaatatatttttaagataaaggcacaaaaataaaagaagcgtattactgggtatagtatgtgactcctcttctcagactaataaattatcttttgaatccttaaataga

SEQ ID NO: 77937 - DNA, 1239 bp, Homo sapiens
  misc_feature (1149)..(1149): n is a, c, g, or t
  misc_feature (1197)..(1197): n is a, c, g, or t
  misc_feature (1211)..(1211): n is a, c, g, or t
  misc_feature (1224)..(1224): n is a, c, g, or t
  misc_feature (1238)..(1238): n is a, c, g, or t
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcatgtttatagttttaacccctacatgtaggtgtatggtccttttncaaaaacaattttttcctggaatttctagtgtgaggattctccttttnacaaatggcagggntggggatctaatnctaaatctgtttant

SEQ ID NO: 77938 - DNA, 1197 bp, Homo sapiens
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggtgtacacacacagttacacttcatggagttgcatccagccaagtatccatgtccttcttgtgaagaggcagagaaaatcacctctcccaagaatttccaccttctgaacaagggaaatgtatcctgaagagctgtacgcagatgggaggcaacttgtttgcttgttctgctgctagagcattgatttaattagaagacaggctgtgggtggccatgtgcagacaaagaagcaccagacagagcccatttagcctgggacagtaaaaatgtttatagttttaacccctacatgtaggtgtatggtccttttcaaaaacaatttttcctgaattctagtgtgaggattctccttttacaaatgcaggaatgggatctaatctaaatctgttaggtgaaattgagtgtgatgccagcataatggatggaaaatccttaaattttggagcagttggagcactgagtggtatgtgggcattatgacctactatctttggaaaatcatgcacgtgaccatttcatgccttctaaagatgattacagtctttttcaccatttctgcttggaatagtgtttaaaacaaatgttctttttttattgaatttaaaacatacagtcttagttataagtagtttttggtttgaatttgatcattctcctgtatcccttgaagagattaaagacatttaagacatgatttagaatattaattttacaatttgaaatacacactatattttttgttgtaaaaaatttcaggtaatataaataaaatttacctttgatcctccaaaaga

SEQ ID NO: 77939 - DNA, 569 bp, Homo sapiens
aggattttcttctgggaaggctcttcagatatcttatttgacccattgccctaatatttcttaaatgttatatttaatgttttttatttttattttataggattcagtttagctgcatttaaaagaaacaagaggaaactagagctggcagaaagggtggacacagattttatgcaactaaagaaaagaagacaatcaagtgagaaggtcaggtggtgtttgaaatattcaaattaatgtatcagatgatatatcttctgcatttagatacaagctttaggacgatacaattcagtagaaatagaatgtgtgtcacatatgtactttaaagtttttcagtagctacattaaaaatatgttcataatattaggctcataaaagagaaaaagaaagtagaaagaaacaagggaaattaattttaatatattttatttaaaccagtggatctaaaatataactttgaaatatgatcagggaaaaattattaatgagctattttacattatcgtttttagtattaagtcttcagaaccagtttgagttttccacatctcaattataacactaa

SEQ ID NO: 77940 - DNA, 2699 bp, Homo sapiens
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggtgtacacacacagttacacttcatggagttgcatccagccaagtatccatgtccttcttgtgaagaggcagagaaaatcacctctcccaagaatttccaccttctgaacaagggaaatgtatcctgaagagctgtacgcagatgggaggcaacttgtttgcttgttctgctgctagagcattgatttaattagaagacaggctgtgggtggccatgtgcagacaaagaagcaccagacagagcccatttagcctgggacagtaaaaatgtttatagttttaacccctacatgtaggtgtatggtccttttcaaaaacaatttttcctgaattctagtgtgaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagtggtagtgctccatttaataacagtaataagtaataaagtgtttttatttgttaaccagtttaagtggatcctgtggtaacttaaactgttgttctcatcccttatatggggcatttttctttaacaaagaatggtttcagtgaaacaatctagcagagaattaatgtcagaacctttttaaataatagtctgattgatacagtttgtacttatttcatcaagcttttctaagcttaaatattgcatagcttcgagctgtatggactatattatgaaagaatatgtaaagagaacatacagtaatgcacagtccttaatttgtgtataatggaaagttatttacaatataacactgtaaataagaaagcaaagtttatgggaaaattcaatattatctttgtttttgtttaaatatatttttaagataaaggcacaaaaataaaagaagcgtattactgggtatagtatgtgactcctcttctcagactaataaattatcttttgaatccttaaataga

SEQ ID NO: 77941 - DNA, 2623 bp, Homo sapiens
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggtgtacacacacagttacacttcatggagttgcatccagccaagtatccatgtccttcttgtgaagaggcagagaaaatcacctctcccaagaatttccaccttctgaacaagggaaatgtatcctgaagagctgtacgcagatgggaggcaacttgtttgcttgttctgctgctagagcattgatttaattagaagacaggctgtgggtggccatgtgcagacaaagaagcaccagacagagcccatttagcctgggacagtaaaagattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagtggtagtgctccatttaataacagtaataagtaataaagtgtttttatttgttaaccagtttaagtggatcctgtggtaacttaaactgttgttctcatcccttatatggggcatttttctttaacaaagaatggtttcagtgaaacaatctagcagagaattaatgtcagaacctttttaaataatagtctgattgatacagtttgtacttatttcatcaagcttttctaagcttaaatattgcatagcttcgagctgtatggactatattatgaaagaatatgtaaagagaacatacagtaatgcacagtccttaatttgtgtataatggaaagttatttacaatataacactgtaaataagaaagcaaagtttatgggaaaattcaatattatctttgtttttgtttaaatatatttttaagataaaggcacaaaaataaaagaagcgtattactgggtatagtatgtgactcctcttctcagactaataaattatcttttgaatccttaaataga

SEQ ID NO: 77942 - DNA, 613 bp, Homo sapiens
ggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgagctcatgtggaaaggacaatttcaggtactgtgtgtgctaactaacctcttcctggacatcataaagaatccaactaaaacaaagtttaaaactatttcaaatgtgaaagtttattgaagccaatattctattttagagatttgtgttatgtttttgacaagtaactgtactgtaattatgtggctttcaattaaaaaatgtgaaaactgtt

SEQ ID NO: 77943 - DNA, 298 bp, Homo sapiens
tccacgttgacaccttctgcacaggtgcatttgtgagtcccctcggtgtctctgcagcatctatgtgtggatgaatagtgaagccacatgaggcctggtctgaagcagagaagatccgctcagcatcacgttgaatcccaagcccgcatctccgtgggctccaggacaatcctatgaaaatgacaccgtcggttcattgttcacatcggggaggagaattccgtctgaaaatgagcgtgacttcactgacacccaagtccgtggcacagccctgtgctgagctccacagacctacagt

SEQ ID NO: 77944 - DNA, 196 bp, Homo sapiens
cagaggatacttccatggtccgtgcctccccatctcccagcaattctgcatttccaagattggcacctctggtcctctgcacggtgaagccccttcctttcaattccccagtagccagtgctctaatccaccaggtctcaggcatgatctatgtttctccacactcgctttctgaggagagttttgcctgggttct

SEQ ID NO: 77945 - DNA, 381 bp, Homo sapiens
tttttgacaaataagacattacaatataattttttaaaaacaggagacaatactatgcaatattatgtaatttgcatagggacagtgactagaacgatatggccgggtacagtggctcactcctataatcccagcactttgggaggtcaaggagagtgcataacttgaggtcaggagttcgagaccagcctggccaacatggtgaaaccccatctctactaaaaatacaaaaattagttgggcgtgctggcgcacgcctgtaatccccactacttgggtgtctgagacaagagaatcgcttgaacctgggaggcggaggttgcagtgagctgagatcgtgccactgcactccagcctgggtgactgagcaagactgtctca

SEQ ID NO: 77946 - DNA, 327 bp, Homo sapiens
ccaaagtgctggattataggtgtaaaccaccatgcccagccctggacaagttccttaacctctttgtgcctcattttcctttactgtaaatgaggataatattagtaccacctacattcaatacacttaaaatagggcctggctcataacagtaagcactagatgaatgttggctactatagtctaataaccataacactcctacagctgactttaccaagaggcagtggcaaaactcaaatgtgaatctaggctttctgaggctaactgcctcaagtcacggagaaagacatgcccagattattaaaaacattattcaacatagaa

SEQ ID NO: 77947 - DNA, 2272 bp, Homo sapiens
tgcggagtccatcatggtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagca

SEQ ID NO: 77948 - DNA, 1016 bp, Homo sapiens
tcgctattgtatctcggcgttgcttggagcctccctcgcgtggtgtgttccccggtttgtggccctctcggtcttccctacctggagatttttcacgacgtcttcggtttacccccgcggcgctttttttaactgtgggaggaattctcccggcccctagtttcctagtgccccgggttcttccttagggtacccgcgttgtgcccacgttgcccgcttctcctctaggggccgccgcgcccctacggcttggttcttggaaagctttttccaggggcctctgtcgtgcccacacacgtttttttttttgtttccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagca

SEQ ID NO: 77949 - DNA, 2286 bp, Homo sapiens
tgcggagtccatcatggtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgagtctgacaagggatccttagatcgacctcagaatgcagctgca

SEQ ID NO: 77950 - DNA, 1402 bp, Homo sapiens
tgcggagtccatcatggtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggcacatacctcccaccgtcctgttaccctc

SEQ ID NO: 77951 - DNA, 1406 bp, Homo sapiens
tgcggagtccatcatggtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggccaattccagattctaaactgatttttttcatgatattgtcaaaacagtgaggaaacattaaaaaaaaagccctaaagca

SEQ ID NO: 77952 - DNA, 211 bp, Homo sapiens
ccccatcaggcgaagaccgtgggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagca

SEQ ID NO: 77953 - DNA, 415 bp, Homo sapiens
caattccagattctaaactgatttttttcatgatattgtcaaaacagtgaggaaacattaaaaaaaaagccctaaagcacgcctggtgtctgtctctgctttttgggagggctatttcaggatgggggtggggtctggacccaggtcctagagctgtccaggggggcctgaggtggcttctgtctctctgtccgtgaggacccgcccttcctgcgatgctgtctgcctgggcaggccccttcagagtctggggactcaggtgtccctaactgccatctcttggaagcccttggcacttggtcgcttagctgttctgtgcctccctctcctgctctgtaaaatgggtatcctgccactcttagagggttgaggcacagaaacagtgacatgggctttttgtgggggagggggttgg

SEQ ID NO: 77954 - DNA, 2697 bp, Homo sapiens
tgcggagtccatcatggtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagcaaaaaaaaaaaaaaaaaacaaaaaaaaaaaaaaacaaaacaaaaaaaacaaaaaaaaaaaaaaaaaagagggggggggcgccacaaaatttccccccggggggcgccccattcccgcccccgcgttttctgaggcgcacaaaagggggccccactaagaggggcccgagtcaactaaacccagacagcgacggcgcccgggcttaaaaaaacgcccgcgtgcgggggacaaccaggctcacgcggacactcggctgggacaagaccccaccacggggggggaaacatgcgcggccaccacccacccagagaaatgcacggccccgagcgacacatataccagcaccggtgatcgtgttgacagcccgggcaatgccgcgccgacaaatctgcgctcggtatcgacaaaaagtaggcgggcgaacaa

SEQ ID NO: 77955 - DNA, 2180 bp, Homo sapiens
tgcggagtccatcatggtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgctattggaaacaggagcaccaac

SEQ ID NO: 77956 - DNA, 760 bp, Homo sapiens
ttcctggcaattgcatgtatatttttttctgcatgttatttggatgtgaggagctgtcattattattttaggaacaaatatgaaacaatctctggaaaatggaatttgattttgattcaacaacaggagaattctactgtttttctccagcagctccacgataaaagggaaccctgagcagaacacatgcacaaactcatgccataccctaagggacaaggttccccacatctacttggaaatctttgggatgctcaatgattagctctttggaactgagagatgagatgaggcctggaaaacttcccccagtacagtcaagttcctgttgactaattctgtgaccaccagtgacagtctttgagtccgtgaggcagagttgcggcagcacaggctttgcttggagttggatggttcgcaccctgcttggcatggtttctaagagacatcctctgagtggatgaggggagaatccagcaggcctctagtcacactggtacgaataattttgatggtgggagatggtggtgtgagtggagggtctgtgggtgtgatgaacacctgaatgactcatggggagagggatgttaacaggacagatgccacttgctgtaattttcatatgatgtgtttggaaagccccctgcatggaggaaagatagatcgaggtccctttcaaaagtgctccagatgaagaggcatttccactttcagaaaccctgagaatccccgaaagaacctctaactagtcattgtactg

SEQ ID NO: 77957 - DNA, 937 bp, Homo sapiens
ttagaaatatcactttggaggccatgtgcagatcagatttggaagtgaccaagactggaggcagggacaccagagttttctgttaaaaactggtccatgcaagaaaagatgactcctgaaataagacagtgatcattaggatgaagaggaagagaagatttgaggaatacttagaacagaatttactgaatttactggttgaattgaatgtgaagaggagatgaataaagaagaaaacaccctcaaaggaacaaatatgaaacaatctctggaaaatggaatttgattttgattcaacaacaggagaattctactgtttttctccagcagctccacgataaaagggaaccctgagcagaacacatgcacaaactcatgccataccctaagggacaaggttccccacatctacttggaaatctttgggatgctcaatgattagctctttggaactgagagatgagatgaggcctggaaaacttcccccagtacagtcaagttcctgttgactaattctgtgaccaccagtgacagtctttgagtccgtgaggcagagttgcggcagcacaggctttgcttggagttggatggttcgcaccctgcttggcatggtttctaagagacatcctctgagtggatgaggggagaatccagcaggcctctagtcacactggtacgaataattttgatggtgggagatggtggtgtgagtggagggtctgtgggtgtgatgaacacctgaatgactcatggggagagggatgttaacaggacagatgccacttgctgtaattttcatatgatgtgtttggaaagccccctgcatggaggaaagatagatcgaggtccctttcaaaagtgctccagatgaagaggcatttccactttcagaaaccctgagaatccccgaaagaacctctaactagtcattgtactg

SEQ ID NO: 77958 - DNA, 444 bp, Homo sapiens
ccttctgttacgcaggctggagtgcagtggcaagatcatggctcactgaacccttgaacttgtaggctcaagcgatgctcccacctcagcctcccaagtagctacgactacaggcatgtgccaccaagccttggctaacgttttgttttttattttgtagagacaaggtctcattatgttgcccaggctcgtctcgaacttttgtcatgttctttgtcatgaaggatctcaagtgatccttctgcctaggcctctcaaaatgttgaaattagaggtgtgagccactgtgcccagcctaatcacagatttttagcattgaaacagatgactttagacatctatttcagtttcctcatattatatttcaggctcagtttctttgtaaaataataaacaagcaataaggtatatttggcaaatagaggaaagctgaaaaattaccca

SEQ ID NO: 77959 - DNA, 165 bp, Homo sapiens
ggcaagtctaatcccagcagggctaggattaattaggattcacttattaacacttatcaaacctctggcagaagtggcttgctaaacttagaaacttggagaggaaaaatatgagtatacaaagatgggtgagttttgcctataaagaaaaaataattatgatcc

SEQ ID NO: 77960 - DNA, 549 bp, Homo sapiens
agttttggctgtcgtgactggagggaagtggtgctcctacatctaatgcgaggaggacagaggtgctgctaaacatcattcccacacaggacagcctcccgcaacaaagaattgcctggtccaaaatgggtgggaaagcctgacttagaggcttagggagttttcccctcctgctaaatgacttgaagcgattgccacatgggttacacataaaatgtgtccatggcatacagttctgactgtaaaatgagcgtcactcaatggtgacaggaaactggaagcactgttaaaatgggaagatatgaaccaatccttatctacatgacacctacacatctagaactttacgaatttctctcatgggctcctggatctggacatttacatgatgccaggcatatagctgtgtggcttcttgcaggcaaaattcccaagtgattgactacatctcttatttttcttccaggtgtttgtgtacagtttaagcaatcacagtctctgcgtagaaagatcttctcaaatatactactgcaaaaagcaaaaaaaaaa

SEQ ID NO: 77961 - DNA, 187 bp, Homo sapiens
atacaatgtaaatatacattatataatgtacaatatacaatgtacattgtgtacagttatataatgtacattgtaaagtgtacattatttaattgcacattgtaaattgtacattatataattgtacattgtataatgtaaatatacattgtattaggtactataaacaaataactgtttagggaat

SEQ ID NO: 77962 - DNA, 258 bp, Homo sapiens
gtgagccgagatcgcgccattgcactcagcctggccgacagagtgagactccctctcaaaataacagtagtaataaataaataaagtcgttgcttgcaggctgtacaaaaaaaggcagcaactggacttggcccctaactcatagtttgccaaaactctgctctaaagtttgcttgcttcattcacttctcagagcctggccctgggagccgcctatcccagtcctcatcccacatggccagcgttctcctaccttca

SEQ ID NO: 77963 - DNA, 2581 bp, Homo sapiens
  misc_feature (922)..(922): n is a, c, g, or t
  misc_feature (924)..(924): n is a, c, g, or t
  misc_feature (932)..(932): n is a, c, g, or t
  misc_feature (937)..(937): n is a, c, g, or t
  misc_feature (958)..(959): n is a, c, g, or t
  misc_feature (962)..(962): n is a, c, g, or t
  misc_feature (968)..(968): n is a, c, g, or t
  misc_feature (1041)..(1041): n is a, c, g, or t
  misc_feature (1138)..(1138): n is a, c, g, or t
  misc_feature (1259)..(1259): n is a, c, g, or t
  misc_feature (1308)..(1308): n is a, c, g, or t
  misc_feature (1936)..(1936): n is a, c, g, or t
  misc_feature (2193)..(2193): n is a, c, g, or t
  misc_feature (2212)..(2212): n is a, c, g, or t
  misc_feature (2214)..(2214): n is a, c, g, or t
  misc_feature (2440)..(2440): n is a, c, g, or t
  misc_feature (2500)..(2500): n is a, c, g, or t
  misc_feature (2505)..(2505): n is a, c, g, or t
aaatgccttggctgagcatgacctgctcaccaattctctctaatgtggacatttatcatgctgcccagtattgggaagaatgtcttagaatttctcacgagctcctagtacaagtctggtctagtttctgcctccagcccctccactgaaattgctcttgccaaggcccccagcaacacttgcattgcttaactcagtgaacaggttttaatgcttatcattttggaactcagcaagtgtttctgagtttgtcccttcttcttcagttcctctggcttccttctgcacctttgctctcatctctttctggcttgattatcttttagcgtgcccccccaccccgcaccaactttatctgtggagacactcctctagtcttcttccaatgatgttcctcttttgcttgccccttaaaagaagttgtccttggtccccttatatattctatgtgctctccctgaatggtctcaactacattcatggcttcaagaactaccctgatgagtcgcaaatctgtattttcagtattgacttcactcctgaactcctaagccaaatctccttcatctccatctggatatcccacaggcatttcaaatttcacacgctcaagactgaactcatcttcctacccatacgcagacctcctccttcatcccatttgtccaggaatgactccaaagtctgtggtcacctcactctatccctgtggagtcatgctagagctttttcacttccccatcgccactcccctcccctgccaaccaatgccccgcttttccaattggctaacttgtactcgttcttcaagcttcatattggacaccatttctccaggaacatttccccaaccccaaacgtctgtgtaaagtactcctcttatgtgttcctacagcactttcttagtccatctgtgttgctntnaaggaatncctgnggctgggtaatttataaagannagnggtttntttggctcatgattctgcaggctgtacaggaaacatggtgctggcatctgcttggtttctggtgagggtctcnggctgcttccactcatggcataaggtgaaggggagccggcaagtgcagagatcacatgatgagagaggaatcaaggtggggtgggggggaggtgctncactcttttttaacaaccagctcttgtgggaatgaatcaagtgagaactcactcattactgcgaggctggcaccaagccattcatgaaggatccaccccatgactcaaacaccttccattngaccccaccttccaacactgggtatcaaatttccacatgagatttggangggtcaaacaaaccaaactataaccagcaccttgaacttcccctctcatagcacttatcacagtatagtgttgtcattgtctggctccttgtctgtatgttccgccagactgcatgcagggatctgatctatatttctcgttggtgttgtctcaatgcttaacacagtatacctggcactacccttcaatattttttgaagaatgagcacatgaattatcatgtctccagctaggttcgccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactacngctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatatnaacagaatgcatggcggancnggggcgggggagggggctcatggtcatcttaatcatgtacaaaaaggatcatttgacaaacgcagtaccctttcatgaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatngtactcaaagttctagtcagggcaattagtcaagaaaaagaaataaaaggcatccagatnggaanggaacaagtaaaaccatctctattcatagatgcatagatggcatgttcttatatagaggacactaaagagtccaac

SEQ ID NO: 77964 - DNA, 340 bp, Homo sapiens
ctttctcctcacagggcaccagcctccaaatggctatggaccgggagcagaaccaggttttaatggtggcctcgagccacagaaaattggtgagtcctcctgcgcccccgacccatgttgagcggaagctggcatctccctcatgcctgagtcagtctgtctgtccgcatccccctgtctatgagctggtcacctggccctcctgatgctgtccctgttccactagcctgtccctagctcctctccaatctctgtcctgcaggtttaggttatgggaatggtgtcctgggagccagggtcttccccgaggcccacccacagccaggtgcctggggagcag

SEQ ID NO: 77965 - DNA, 532 bp, Homo sapiens
ttttgagacggggtcttgctctgatgcccaggctggagtgcagtggcatgatctcagcttactatagcctctgcctgcaagcaattctcctacctcagcctcccatctacttgggaggctgagatgggagggaggattacttgagcctgggaggtcaagactgcaacgagctatgactgtgccactgcactccagcctatgtgacagagcaagcctgtctcaaaaaaaaaaaaaaaaaaaacggttttagtctcaacttatacaaacattgtacttgatagggctcagaaatgagctgggtagctggagtatacaggcagggatttaaattttacagagataatgcggggttcatggtattaagagtttggcagcaatccccagaagttaagaaatttcaaacaaaggctgacaggagacagttggctggagaatgaaaaagtctggtagagttgaagtatatcatatattaggatcaacaccattgcaatgaatgttcattgccagatcactacagttagaaatgtaaaaa

SEQ ID NO: 77966 - DNA, 392 bp, Homo sapiens
aaacaacaagaattaaaaacttattatctttgaactgatagtatttaagataaatttatcagtttgtgtgattatagaaatttacttttctagttatgttttaggctgataatacaagtttctaggctgggcgtagtggctgacacctgtaatcccagcactttggggggccaaggtgaagtactacttgagcccaggagtttgagaacagcccaggcacctcgtttctactgaaaaaaaactagccaggtatggtggtgcatgcctgtagtcccatctacttgggaggctgagatgggagggaggattacttgagcctgggaggtcaagactgcaacgagctatgactgtgccactgcactccagcctatgtgacagagcaagcctgtctc

SEQ ID NO: 77967 - DNA, 509 bp, Homo sapiens
cgtggacggccacccagccttcccagtttacatgatcatggggagagcctgtcaaaagcaactgcacagagcctgtgcttaagatggcaggatcgcaagacagagcaactggagcaagtcctcattaagaagagccgcccgatgcatttggactgcgatgtgttacgcccatgagatttcagggttaatttgttacctggccgtggcctatcctcttccagcagatacagaggcttactgcagtttgcaactttgcagataccagcagaggaagaaaaacctgggagactgctgctaacctaatgtggagacttgacttaaacttcagccagacaaaggcggaatcttaatatggaggggcctggctctgcagggaggtcacctgggctggctggatttcaatccagttacacagcaaaaaagttacaacccaagctttggcgatgctgagccttctactctcagggattccaaagcatttgataaactctttctttgttccattgtta

SEQ ID NO: 77968 - DNA, 315 bp, Homo sapiens
agagatcaaatgtcttaaacattatggaataggagtgtatgactgactaacatccagtaatcattagggaaaacaaacatgagtgaggacaactgaaataattatgatacaattaagggtggtaggttacatttgtatagttctttaaaatatgcattattccacatgatcagaaatataaaaagaactagacagatactggtagagagacaattaatttaaatttgtaacatattgcttggagcaagcattcaagttgagtgcttaatgtgtatcggtgactgcactgtgcaaataaatttggggttagtaaga

SEQ ID NO: 77969 - DNA, 2045 bp, Homo sapiens
gctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctgggatcccatcacctcaaagccagagggtccccaagtcaccgctgagagcacttgagcctcaaggatgtaagcctgaccataggatcttgactccaacagcggcaacccccacccccattgtggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaagggcaacacttcggccccacctggcaacaattctgcatcctccctactgtcgccacctcttttggcactttcc

SEQ ID NO: 77970 - DNA, 2310 bp, Homo sapiens
gctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctgggatcccatcacctcaaagccagagggtccccaagtcaccgctgagagcacttgagcctcaaggatgtaagcctgaccataggatcttgactccaacagcggcaacccccacccccattgtggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaagggcaaaaaaacacaaaaaaaaaaaaaaaaaaaaaaaaaacaaaaaaaaaaaaaaaaaaggggggcggcggcgaaggaaaaagacccacggggggggcccacaacgataagcggcaccacacgtttttctgaaaaaggggccccatagaggcgacaccaaaaaaaagcacggcaccggccccacttaaccaccgctccgcggcggcaaacgacaacggcggatcatgggagagcacccaccctgggcgtggcgcatcgggcaccaaccccaggaataagccccaggaataaacttaggttgcgggcaccacggctctggggaacgcgccggacgaaga

SEQ ID NO: 77971 - DNA, 1929 bp, Homo sapiens
gctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctgggattggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaagggcaacacttcggccccacctggcaacaattctgcatcctccctactgtcgccacctcttttggcactttcc

SEQ ID NO: 77972 - DNA, 1997 bp, Homo sapiens
gctgcgcgcccagaggcccagagtcggagctcaccgactccggagtcgcgatcccaggagccactggacctggtcctggtgcctgatgactgccggcctggcacacccccgagtgacctcatcgagatccaggtggtgaaggtgacggacaccacgctggtccctgagcccccggagccaggttctttccactgtgccttgtgccctgctgccttccggctggtttccgagctgctgttccacgaacatggccacttggctggggccgagggaggcgggcagggtggggacccgagccggtgccacgtgtgcggccacagctgcccgggccccgccagcctgcgcgcgcactacagcttgcacacgggggagcggccctaccgctgcgcgctctgcccccgcgccttcaaggccttggcgcccctgctccggcaccagcaccggcacggggtggagccgggcacctctcggaggcctccggacacagcggccgttgcagaacagaggcccggggtggccccggagagggcggaggtggtgatggcggcggcggcggcgggcgcagcggtggggaagccttttgcctgcaggttctgcgccaagcccttccgccgctcctcagacatgcgagaccacgagcgcgtgcacactggcgagcggccataccattgcggcatctgcggcaagggcttcacccagtcctcggtgcttagcggccacgcccgcatccacactggcgagcgcccgttccgctgcacgctctgcgaccgcaccttcaacaactcctccaacttccgcaagcaccagcgcacccacttccacgggccggggccggggctgggagactctggaggccagctgggctcgtcggcggctgaggggtcggggagcgggtgtggggtaggggaccctgcggaggaggggcggggggagaccgcgaaggtgaaggtggaggccgaccagtaggctgcagaccagggacatgggttagttaaggcggaggtacgaggccgacccggggagggggacggggtggggaaacggaggcaggggacagaagaggggagattgggggagagatgacagctgcagggatggttgtgagccgctagtgatggagagcagagggagagggccaggctccagactcccacacgcccacacagcacctctgccaggcctaggagaggacaggtgcagctcttgcagctctgcgggtgtgcggccaaaggcaaggcccacgggctggatgtcacttccccgactgtctcttggttggcttgtccttgtgcaagacccagcctgtcacgacagagcctgggcacttcagaggaggagccaggatcgaatggaaggggggaattggggtccaccatagtcttctgctctggtcctccacgggtggaccaggatggagtctcctgcctacctcactgcattgcactggacctgggatgcctatccaccctctggcagaagacactcaccaggttatctgtgaagagactctgggatcccatcacctcaaagccagagggtccccaagtcaccgctgagagcacttgagcctcaaggatgtaagctggtccgtccttaacccatccactcttcttcggaggcaactgagaacacataaagcaagcagctacctagcatccccctcctaaagctttagactcagagcccagggtcccccacaagcctcaaggtagcctcaggtttctctaatttcctccactcccagttcgaagcaaacagcttactgcctagtccccgccaatcccaagggcgggctggctgatggcagcatggtgggctggcctgggtgtggagtgaaagagtcactgtggtgggggcgagaggaggacttgggagctggaggtgtgacaccttcagttctgttcctattaaaggaccttctgaagggcaacacttcggccccacctggcaacaattctgcatcctccctactgtcgccacctcttttggcactttcc

SEQ ID NO: 77973 - DNA, 738 bp, Homo sapiens
ttccagattagcttatgtaattacatttctttttgtctgtttgttttttaaattatactttattaggcaaagcatagaccatggttgtcaccctaattcacacttatgtagcattatgatctattatacatcatttttaatggctaaatatgattacattgtctagcttatgatagtgtatttaaccatgtccctatggatggcattttgattatttgcaaaaaactgtcattttcaaccacctttaggcttacggtaattttcttcaggattacttaaaaatcattagggtccctagcatctacccagaagatcacagtaaaaatacaaaacgaatctattggccagtgaaaacatccaaagaagagaaaagtgagacccacagaatcagaggcatgcagtcatacctcaacagctggtaactcaattactagacagtgtcaattatcaagtaaataccagtagccaacagctagacaaaccagagctgcaaacggtaactaagatgcatcaacttaaaaaaaaattaaaaaaagaatcaactttatttatagtacagatcttcagataacaacttggttatctgagtccttatgcctaggcagagaagaagtcacaaacttgcatgaaggacaaatggcttttataaggaggcatgttgatggcaggtgtgaaagttgagctactaacacccaacaagaaaagaaacccaacaagcaaaaactggtaatatggggg

SEQ ID NO: 77974 - DNA, 6577 bp, Homo sapiens
agagggcaaggagagagcagagaacacactttgccttctctttggtattgagtaatatcaaccaaattgcagacatctcaacactttggccaggcagcctgctgagcaaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcgcaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcggcttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagtttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatactgggacttcagaagtgcaatgtatttttctcctgtgaaacctgaatctacaagttttcctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagcctttttttttttgtatttcagagaaaattcaggtaccaggatgcaatggatttatttgattcaggggacctgtatttccatgtcaaatgttttcaaataaaatgaaatatgagtttcaatactttttatattttaatatttccattcattaatattatggttattgtcagcaattttatgtttgaatatttgaaataaaagtttaagatttgaaaaaagt

SEQ ID NO: 77975 - DNA, 696 bp, Homo sapiens
gagatttcgccattgtactccagcctgggcaacaagagtgaaactccatctcaaaaaacaaacaaacaaacacacaaacaaacaaacaaacacattccctcccaggccacccaagtgagggcatgaagcacagcgtgtgtgtgtgtgtgtgtgtgtgtgtgtgcacgcgtgtgtgcatatgtgtgtttgtgtgttgcaggggttacagtggacaggatgtgggagggcagctgcagctccaagctgcaagtctttctgatagaatgcttaaaactccttggaccacagcaagagagtgttttcatttgcacccatttttattagcgtttgaacctgtactttttgtagcatgtaaaccttaagctgcttaactattccttgaagcatttacaccagcggttcccaacctttttgctacctgagaccagttttcttgaagacaattcttccacggacccgggagaaggggaagggatgatgtggagatgattcaagcccattacatttattgtgtgcttcatttctattatttcactgtaatatataatgaaataattacacaactcaccataatgtggaatcagtgggagccctgagctagttttcctgcaactgcatggttccatctgggggtgatgggagacagtcacagatcatcaggcattaggttctcataaggagcacgcaatctagatc

SEQ ID NO: 77976 - DNA, 525 bp, Homo sapiens
gagtgaatagagggattatgagtgacaggagatgcagagaacagtaaagatgaggtcaacagaagctccaagctgcaagtctttctgatagaatgcttaaaactccttggaccacagcaagagagtgttttcatttgcacccatttttattagcgtttgaacctgtactttttgtagcatgtaaaccttaagctgcttaactattccttgaagcatttacaccagcggttcccaacctttttgctacctgagaccagttttcttgaagacaattcttccacggacccgggagaaggggaagggatgatgtggagatgattcaagcccattacatttattgtgtgcttcatttctattatttcactgtaatatataatgaaataattacacaactcaccataatgtggaatcagtgggagccctgagctagttttcctgcaactgcatggttccatctgggggtgatgggagacagtcacagatcatcaggcattaggttctcataaggagcacgcaatctagatc

SEQ ID NO: 77977 - DNA, 116 bp, Homo sapiens
atactctggtttctcttcagatcgcataaatctttcgccttttactaaagatttccgtggagaggaacaactctgagtcttaacccaattttttgagccttgccttggcaaggcta

SEQ ID NO: 77978 - DNA, 1826 bp, Homo sapiens
tatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttacccaagaaaaaacaactg

SEQ ID NO: 77979 - DNA, 1328 bp, Homo sapiens
tatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgcca

SEQ ID NO: 77980 - DNA, 1093 bp, Homo sapiens
tatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaaaactggttagattttgcatgaaatggttctgaaaggtaagaggaaaacagactttggaggttgtttagttttgaatttctgacagagataaagtagtttaaaatctctcgtacactgataactcaagcttttcattttctcatacagttgtacagatttaactgggaccatcagttttaaactgttgtcaagctaactaataatcatctgctttaagacgcaagattctgaattaaactttatataggtatagatacatctgttgtttctttgtatttcaggaaaggtgatagtagttttatttgatactgataaatattgaattgattttttagttattttttatcattttttcaatggagtagtataggactgtgctttgtcctttttatgaatgaaaaaattagtataaagtaataaatgtcttatgttacccaagaaaaaacaactg

SEQ ID NO: 77981 - DNA, 509 bp, Homo sapiens
gtggtgttctcataaatcattttcctgtcaaaattatcagactttattattgctgaatgttttaaatattacaatggaattttggttgcataaatcataatcccttcaagttagaacatttgtgtacatacctcagcatttttcttatatctcgattttaaaaaatagccctcattctagaaataaatccatgcagactgtaaatgtcaaactgtactcttaaatttcagtaactcagcagtccaggctggccactgtgcttgcaaggtagttaggaattgtcacactgtgtttgtaagactcactgttcccaaaaatgcagccgtacacactggtgttttaatcttggtaattatttttatctgcaagcattttactacaagtgacatatactcacttgatttttccatttcctgcaaaaacaaacaaacaaacaaaaaaacccagaaataacaaatctgggaattgcttgttcctgacattagaaagtaatttattcttaataaaag

SEQ ID NO: 77982 - DNA, 1747 bp, Homo sapiens
ccctgggaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatattatgaaacaaaaaaaaaaaaaagattctgcttatggaagtagagaggaaacttaagatttatggcagacaaccctgttttttttaaatagcaaatcctaaagataacttttagcctttgtggaagattgagcctaagtagaaacctta

SEQ ID NO: 77983 - DNA, 1700 bp, Homo sapiens
aggtttcagggaaaggagtttatttgggaggtgattcagtgggggagtggggaagtaagccagggaaggaagggggctttgctgtttcttttttctttttctatcatccagtccaaaatgtcaggaagggggctttcaaaggcaggtggccgctgtgggtggctagagcttaatccctcggggaccctgggagccagtgcagaaggcgcacagcagtttcccgccccctgggagaaggagcaggggagtttgtacaccgactcgtagccattggttgagggctgccttaaggggctgccatctcctgactctgtttgcaggtagctcaggtggccagagaaggtcctcaggcagagacacagatgctggcagctagaagccaaggttgggggtggggagggaactagctccaggccccatcagctgggataaggccggtgcaaacctgagctggtgtctccaggaagcctagccctgacctgccaccccctctccccaccctccagggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatattatgaaacaaaaaaaaaaaaaagattctgcttatggaagtagagaggaaacttaagatttatggcagacaaccctgttttttttaaatagcaaatcctaaagataacttttagcctttgtggaagattgagcctaagtagaaacctta

SEQ ID NO: 77984 - DNA, 1134 bp, Homo sapiens
ccctgggaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatattatgaaacaaaaaaaaaaaaaagattctgcttatggaagtagagaggaaacttaagatttatggcagacaaccctgttttttttaaatagcaaatcctaaagataacttttagcctttgtggaagattgagcctaagtagaaacctta

SEQ ID NO: 77985 - DNA, 1069 bp, Homo sapiens
ccctgggaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtgggtatgtgccaggtcctcccatgacctgacctgctgactcaggcgctaagtggctgtccacttggtatgccactggggatcccactcaccccaagtttccttcacagttctgtcttccacctctgcctagaattttccattaatagaagataatacaatgccgt

SEQ ID NO: 77986 - DNA, 929 bp, Homo sapiens
ccctgggaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggcagggttgaggaaccatctcagccatcctcccaggaagcccacccctgacccttactaatttttctaatgtgcaaactttttcattgaaaaataaaatatattatgaaacaaaaaaaaaaaaaagattctgcttatggaagtagagaggaaacttaagatttatggcagacaaccctgttttttttaaatagcaaatcctaaagataacttttagcctttgtggaagattgagcctaagtagaaacctta

SEQ ID NO: 77987 - DNA, 297 bp, Homo sapiens
gatcctgtgcattttcccatcatcagctgtctcctttcctgctttccttccaccccaagtctgctctcagccccagctctcaactggggccccagagtgaggccaggagcctgactccagctagtcttgcatgccaggacaggggcatccctgtaccacaggaagcaggtggctaaacaagagggacttggggtgggacaaaggctgcctccgctgaaggcagaagcagctggggaggccaacttcattctgatatgaagtccttcctactaagtcagaattatttcatcacagacc

SEQ ID NO: 77988 - DNA, 309 bp, Homo sapiens
ccctgcccccatctctctcctgtttcccccactcccatcctcttctgggttcccacttctctcagtgttgccaaggccctgggcgtgaagactgtgggggctcaggccctgaagctgtttcaggaacaccccattttctctgaagttatctcggaccaggaggctgtggccgccattgagaagttcgtgggtatgtgccaggtcctcccatgacctgacctgctgactcaggcgctaagtggctgtccacttggtatgccactggggatcccactcaccccaagtttccttcacagttctgtcttccac

SEQ ID NO: 77989 - DNA, 1930 bp, Homo sapiens
ctgtacgttcttgaaaggggaactttgaaatggatgacaggaagagagccaagaggaaaagttcctacagagaacagcagccaggaccacctcgagggagaaatgcactttggggtgccgcggatgcagacagaaggggtttggggcaggagagacggggtttcaccatgttggctggtctcaaactcctgagctcaagtgatctgcccacctcggcctcccgaagtgctgggactacatccgtgagccaccgcgctcagccctttgagaggtttgaagccgaggagctgtgtgtgaatggaccagtgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatattatgaaacaaaaaaaaaaaaaagattctgcttatggaagtagagaggaaacttaagatttatggcagacaaccctgttttttttaaatagcaaatcctaaagataacttttagcctttgtggaagattgagcctaagtagaaacctta

SEQ ID NO: 77990 - DNA, 902 bp, Homo sapiens
ccctgggaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcgggtaagtgatctgcttccccatcctgtcctctgctgtgtgtcctgggatcagacactctgcttctctgagccctggtttccccagcaatgtgccactgccagggtggggaggtgaggggggaactccagagcccccagtagagggtacgcagtcctgcctgggctcccagatgctcccgcactgacacgctctccacccccgaccctggcagcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgaggtgagtgccgacccagggcaaggaagagagagggcgcctggtggctggacagggtgccccctgtgcctcaccccctcctatctcccctgtggctttgcagttattggatgaagccttcgagctggccaaggccctagcgaagaacaacccgggttgggtctacattcccccctttgatgaccccctcatctggtatgtggaggtcaaggtcacttggtgggggtggcagc

SEQ ID NO: 77991 - DNA, 258 bp, Homo sapiens
gagaaagatttaaaaacacatataaacatcttttctttgtggataaagaagtgtggtcaaactctataccttacctgtaactctggaatgttttgagaatgagccaaaatgtcagattcttccccctatccaaacagcctagctggcaaggtccccagggacccaaatcagacccaaggtgagcatgctggtcctcagtttgtagtgggcaagacctcagggtgagctgaagaacagggccttgggtgatgcaaaatt

SEQ ID NO: 77992 - DNA, 321 bp, Homo sapiens
ccttcagaattccaccacattcataaagatttgacagcaattctatacagtctctttgagaaaatagaagggggtattttctaattcattttaaggagctagtaaataccctgatactgaaatgtatactgcaaattgataaaattatagacccctgcatattaaatttcaaaataaaaatgataaaaatacttgggtaatgaataacagcataacaaaaaaccacagaccaatatctcatgaacatagacacaaaaaatgcttcacaatatgacatagaattcagtaatacatgagaattatataccacaacccagtaag

SEQ ID NO: 77993 - DNA, 437 bp, Homo sapiens
agatggggatggagggaagaaagagacagtatttgaagagacaatggctcagaattttctagaactgacaaataatactaatccaaagattcaagaagcccagtgaaacccacggaaaataaaagaaaaaaccagtcacacgtagatgcatcatagtgaaattgtggaacaccaaaatatacaagacattaaatgtcaccagaagagaaaagacaccttccaaagagtgacagaccaccttccaaagagcgacaccctaaagtctaacttcttcccagctgcagcagaagccagaagatgatggcaatcgtatctttaatgtgtgctggaaagaaaaagaagttctagtctagaactctacacttagcaaaaataacttccaagaataatggcaaaataaacacattttcagataaacaataattgtgtttttcacc

SEQ ID NO: 77994 - DNA, 723 bp, Homo sapiens
gacaacatgtacaagattcttgtgaaagactatctgtctaggaacatgactactgcctacattctaggagatgccttctatggagcagtgttctatgaagggtggtgtgccctacagggtgcaaaagatgaacacttggagagcaggaagcaggtactagaccttggagttcaagaccagcctgaccagcacggagaaaccccgtctctactaaaaatacaaaattagccgatactggtggcacatgccggtaatcacagctacttgggaggctgaggcaggacaatcgcttgaacccggtagtcggaggttgtggtgagccaacatagcgccatttcactccagtctgggcaacaagagtgaaactccatctcaaaaaacaacaacaaaaaaccagccctggcattcctaatatttttgtcctttttctagcatttttttccatctatgtgtcagatacatctatctatatggtatatgtatggaattctgaggagagaacagagactggacaatgcaagctcacttgtctgtttttgtgtccatggcattttaagcatggctggttaagtggactgagatgatgttattttagatagtggaattctggcaatacttggtaataagtgaccacaaacatcataagctatttaatggcacgatatttaaacaagttgtgagactaaagatactacatctttttctttacaaaagaaaaaaaaa

SEQ ID NO: 77995 - DNA, 293 bp, Homo sapiens
tattatgagaaagacatcaagcaaattataaatgagagacattctacaaaacacctgaccagtacttctcaaaagtactcaaaatagtcaagatcatcaagaatgagaaaagtttgagaaattttcacagcaaagagagcccaaagagatatgatgattagatgtaatgtgatattcttagttggtatcttggaagctactcgggaggctgaggcaggagaatcgcttgaacccaggaggtggaggttgcagtgagctgagattgcgccactgcactccagcctgggcaacag

SEQ ID NO: 77996 - DNA, 280 bp, Homo sapiens
acgtataaaatacttgccacataatagaaatgatagcttgttcctgctttctctacatgtactgactatccattaaaacattgaaacttctaagaatatgtacactgaaattgtatgtatatcaatatttgttttgaaaatactgtaaagttgtggtttgagtcacaaatattgtatcagtccatgaataactggaaaagaaaagtaaaataaatttggagggttgtcacattctatagcattggcttttataaagtgtcaacaagatatataattaagt

SEQ ID NO: 77997 - DNA, 708 bp, Homo sapiens
ggaaaaggatgttttcccctcttcttctcagtcaacctttaatgaacagctttcagtagtttcttcattttgtgtttgtcttaacttctggttattttctttggattgtgttagtcttagttctcaaatttagacaaattccttggagtggaagaatggagacaggcatatttcctggtgaagattaaatgactactgtaccccgcctgtgtttgggaattattacagatggttcacatgcagctaatccaaacccaaatttattgcttttatttattattctccgcattctgaacattttcctcctaacccttctcctgagtcaattaatggcatcactatttaccaagttagctaaaaaaccttggtttcattcttgatttctctttcatctcctatgctgcctacaacttgaccaagttctgtttcttccaactcagaaaattaaacctttataatatactcttacttcttgttcctgtctctagtttctctacccttcaagttgttcacacagctacctgcatgatctttctaaagtacatacaacgatctgacaacgataacttcttggatttacagtctttcttgcttccccaccacatgatgaaatccagaatagtgggctcagcaatcaagattccctaccctctggagccttcctgtgtatccagcatcacagttcatcacacgcccagtgctctggct

SEQ ID NO: 77998 - DNA, 698 bp, Homo sapiens
cgtcgactggggtcacgtgactgactgatcacaagcaaaagatgcccgctgccactccatggcccaagatacgaacatgtttatttcttatttttattttttgtaaagatggggtcttgctatgttgcctaaggtggtcttcaactcttggcctcccagtgtgctgggattacaggcgtgagctactgtaccccgcctgtgtttgggaattattacagatggttcacatgcagctaatccaaacccaaatttattgcttttatttattattctccgcattctgaacattttcctcctaacccttctcctgagtcaattaatggcatcactatttaccaagttagctaaaaaaccttggtttcattcttgatttctctttcatctcctatgctgcctacaacttgaccaagttctgtttcttccaactcagaaaattaaacctttataatatactcttacttcttgttcctgtctctagtttctctacccttcaagttgttcacacagctacctgcatgatctttctaaagtacatacaacgatctgacaacgataacttcttggatttacagtctttcttgcttccccaccacatgatgaaatccagaatagtgggctcagcaatcaagattccctaccctctggagccttcctgtgtatccagcatcacagttcatcacacgcccagtgctctggct

SEQ ID NO: 77999 - DNA, 479 bp, Homo sapiens
tgggacctggggctcacacggctaatccaaatgatctcatctcaagatccttaatataattatatcagcaaagctacaaagacctcttttccaaataaggccacattcacaggttttgggggttaggacagggacatctttttgaggccaccatccaactcaatacacatgccgctgttctcctcttcccccaacagccagtcagtttccaagtcttgaagattccatccgcttctcaagtcctacttgcaccattctgatctctttctgccataggaatctcttagaaatttctgacggtttcctactcttcgaaaagttcagaacatacttctaagcctgacatttagggctctctgcagtaatgttgccagcgtattttccatttctttctctttcttcttccctccatgtaccttgccctccagccacactgtgccacttgccgttgccctcactgctcctcccttctctctgaa

SEQ ID NO: 78000 - DNA, 619 bp, Homo sapiens
ccttgagtgcccacttccgaccccatcccaccccagccctggtctcctgctggtggcatgtgacatgatgggaaccgggctggctgggtgccaggtgtgtgtccacctgcatgccagcgtgcacaccggctcacacccacaggagcctgtgtagtgtgtctgcagtgtgtgcgcagcgtgtagccacagagactctgaggcagcccctggtttccctggtataaacagggcttcaaagactgttctgcctttgtcaccatgtcactgtttatcttgggcaatggctttgatctgactttgtcacccaggctagagtgcagtggcatgatcatagctcactgcagcctcaacctcctggactcaagccatcctcccacctcagcctcctgagtagctgggacctcaggcacatgccaccaagcctgggcaatgtagtgagacccccaactctacaaaagaaattttttaaaattagtcaggcatggtgtttcgaacctgtggtcccagctacttgtgaggctgaatcaggaggatcccttgagcccaggaggtcgtggctgaaatgagtgatggttgcaccaccatactccaacctgggtgacagagtgagaccctgtct

SEQ ID NO: 78001 - DNA, 726 bp, Homo sapiens
agcggctctcgctcctccagccatggccctgagtgacatccgagtggccttctccgactaccagcactttgccttgctgtacttggagatgcggaaagggggcctgcggaaccagtggctgcagctctacggtgggcgggctgcggggcggagacccagacacccccgcttcgggtctgggatgtcacccctgtgcctgcaccagccctttctgcacgcggaaggtggaaccgctggctcctggtgtctgtggccgcgggtcccggcccctccctgcccctctctccctctcttcgcccctccagccccttccctttagcttacccgccctccccaccttcagctcgagcgcccgagctgtttcccgaaggcgcccagaagatgcagctactggcgccccaagtgggcctgagccccagccagggcgtcctgctgccgaagtcgggtgagcggtgccggcagccctgctgggagggccaggccccgggtcacacccctgctggaagggccaggccctggtcactccactgatctcagattcgggacagaagtgcccggggcagacccagcctgtctgggtcgggggagggcgagacgttgcccaggccggtgttcccaggaggagatcgccttggggcaggtcgggggcctccgtcccagggaagggggcgcggggtggcgcctcaggctcgatctctctgcagaccagtgtgcgggcgcgctctc

SEQ ID NO: 78002 - DNA, 418 bp, Homo sapiens
tgtaattaagtatatgcttaactcatctgatttatattaggtgtgcaattacatgtttcttatctttcttccttttaaaggttaggtgaaagtaaaaaaagtggtgagagatttgagacattgagtgagaggtataggatcttggaaatgaatgatcattagagacaggttgtacagttaagtaacatgactacttgaaaaacattgtttcattggaccatgggaaggttgttgctaatcttcagtggagtaacttcaatagaattgatgagaaaggggaggcaaagtgtaatatgttattatgtaatatgtaatatgctttattgtctgatggtaataaagttcagaaagtagagaatagaattttcaagattgagatagagtaacttgaaatacctttatgtaaaagttgtgaagt

SEQ ID NO: 78003 - DNA, 844 bp, Homo sapiens
agagcaatgtataatctcaactttccttttcttcccccaaattaaggttagttcactgatcgacaataggtagaattatctagtgtattgattgtccagtgtgtgcccgggagtatgttaggtgcttgctgcaaaatgaagtaagccaaactggagtttataatcatcagacaatttagggtaaacactggtagtctccaaagatgtaaacagctgagggctttagtctactcctctgcaagcttttaacataaggagtatgttacaatgaaaagaaatttcaaactaaattctgctcatgtaaaaacattgcttaactggaaggtgcaaaaaacagactcataggcctatctcataaaactctaaaatcccagatttctgtccttaaaagtcattttgaaaagtagcctgtgtgaaaggtttacttaaagcagttgcaactacattctacagtaggatacatttaaccttctaagtggatcactcaccagaatcctacataccacaaaacaggatcaaatggagtactagttaggttattactccaaaagctgttaatctgcaagcctcgcctgacccaaagtctagttacataaaatatttctaaggctaacccctgtatcttcaacatcattcatttcaccaattatttgtagcatacttaacgttaatacattgtcttgtgtagatttaaagtaccaatatctgggtgcaggcttctaatcagtgtctttcaaataataacttactaatcctagtgtgtggattcatgattgaaatacctagaaaattaactaaagggtcctaaaacaaagttactcccataaatattatgttatatatg

SEQ ID NO: 78004 - DNA, 337 bp, Homo sapiens
gcacccaccatgcacagtgcaggtgccccctatctgtatgtcacctactcatgacccttaaggggccagcacacagatgaggcctgcgagcccctgacagggcaggacacttccccagggtcatgcattctgcatttctaagccaagattctaaagcggcttccaaaaccagccctccctctcacctccccatgtgccaagttgttcctgggcattgccccccactcccacccctaccctggggtcactgggttgtggacaaaccagaggagacaagctccccacagacagccctcacttgggggccccagggtactggtgcttggcccaggcgttg

SEQ ID NO: 78005 - DNA, 455 bp, Homo sapiens
aattagtgggttcctttatgaaaaaaacaaaaacctacaatagtaataatgctcttattttcagcaactttcagggtaacctcaatgataaggaatttttaagtttttaaattctatatataattgttaattatatattgttaaagttgagggcaaagtttatgtactttttggcatttaagctgtattagtgcttttttttatgcccagtcattgcaacttgactgtttccataactgaaggaaataattaagttttaagtttaaaaagttatctgaaattaaaatttaatgaagtttgattgactccaataataaatttggttagctggcttccatcagctcatgagagctattaatacacatctcttcccagctatcaagttaagtgtcttcatattggtaacttgaaatcagtcacagctggagtattcacaaacagaaatgcacaaatgc

SEQ ID NO: 78006 - DNA, 532 bp, Homo sapiens
atcaaaagagattaaaaacctaaatgtaaaactcaaaactaagaaaaccttgaaagacagctgaggcaataccattcgggacataggccatgagcaaagatttcatgagaaaaatgccaaaggcaactgcaagaaaacaaaaaattgacaaatgggacctaactaaactgaagaactctgcacagcaaaagaaactgtctgcagagtaaacagaccacctacagaatgggagaaaatgtttgcactgatttactttcacaaagtcagtttgtgaaagaaaaagagaacaagtggaatttgaaaggcaatggctaatttcttatgcatcagtgaagacattggaatccaatagagttgagtgcaaaggtgagcacactgctttcttgctgtgtaactttgaataattaacataaacgtttaagtagattttcttataccagtactcatcacttaggattgtgatcaggatggaagtattatggtctaaaagttccacatacaacaatacctggcatataatatttaacaagtg

SEQ ID NO: 78007 - DNA, 717 bp, Homo sapiens
tctggagaacagggaatcaggatgttatggggttttaatgtttttatttttatcaaaggaatacattttaatttgtgggactataatgcaggttaatatagcatctgtatggcatcttttgcatatgtagctcccatcccgttttcaaagtgtcctcatcacaacgacaggaggtaggtagatgctacaagcaccaaggtcctcatttttcaaaaaaacaaaatacacagttgagactaaataatttgccaaaatatacacagcaaatcactggcaaaaccagaaaccgaatccaggacagtctagacattttccactgtccacccatccagtggcttttcttcctttccctttagcctctcaaaactcaaaacataacacaagcttcatgtcagatccagtcctctagggaacgccagccaagtgaaattctccacttttccctctcctctgcctcgcttcaggagactgagaaggcactacaaatagtgctctgtggatttccttccttccatgagaacaagccatccctttaccttttgaaccatgtttatacacaggaaccactctcagctcctttctaagctaccctgaaaccagtcaatactaacattatgattttttcagtgggattatatgacaacataattgggatttcacaggtgtaattaaaagaattaattaaatttaaataaaaagaatttcctcttaagaaaa

SEQ ID NO: 78008 - DNA, 424 bp, Homo sapiens
ggatgccctggccgttggtgctctgggctgctccctggataccattctgcttaaggccctagaaatctgaggctgtgatggacatagaagggtagatctccaaaatgtgtttagagtcattctcccattgtcttgatgaatagcttctggcttccttctacacatcctaatttccttatcccatggttgcttggccccacttttgtttttctgtcctaaacacactttttattcttcatacgaccaggctgagaatttttcaaaatctttttattcttctttccttttgattgtaagtttcatctctatattatttctctcttctcttatttttataagcagtaaagagaagccatgtagcactctgaacattttgcttagagatttgttaacaacaaatattctaattcattgctgttaaatt

SEQ ID NO: 78009 - DNA, 891 bp, Homo sapiens
ctacaagttgctaggcttggacccgctggagtcgcagggacacttctgagagctcaccccgggctcttggcaccgcgtgtgggggctcagtctccctctcggaaggcgatcggagactgacatcggcccatccaggagttggagggatccatttgaaagtgattgtttcccctcccgctctccagccgaacagttgggttggcgtcgtcttgcaggtttaggaatcccagctctgccaggccggctggtcttaacctctgctcttcattcactgtggtgcacccacacccagccaaggaaagcacgcgcgagaaatccccgaggctcggccagcccccggggtgccctcttccgctaccgccgcgttccgactctgctgggggacctgccggaagacgcgaagagccaaacttttctttgaggttttcgaggcaagaccgcttcgaaagccggcgcagctgccgcttaaccagttccaggacaccgacaaggctgggttgcggctccggatccccacccttctcggcgcaccgcccggtaccgcagcacttacgactcctctgagatttctgggggtcgccccgctaaggcacagaggaggctgaggaaaggggttctcagactcccgggaccacaagcgcgaagccctctatcagcacgtcgcccttctcctgcagtttcccaccggccgccaaagtaacttggagcgaagcgtggcgcagtgcgagggccccgggcggtggcggagccgtgcgtagcctgctgcgccgacgctgagccgggcccggcgggccggtgtatgtctccccgcggctgcggcgcgcaactcccggtgactgtgcagcgcgcgccgccgcctgccccgacccgcgctgcagccgcccggcccgg

SEQ ID NO: 78010 - DNA, 484 bp, Homo sapiens
tgagacagagtctcgctctgtcgcccaggctggagtgcagtggcctgatctcggctcactgcaagctctgcctcccaggttcacgccattctcctgcctccgcctcccgagtagctgggactacaggcgcccgccaccaagcccagctaatttcttttgtatttttagtagagacggggttttaccatgttagctaggatggtctcgatcttctgaccttgtgatccgcccgcctcggcctcccaaagtgctgggattacaggtgtgaggcaacgcacctggccagcatgttaaaatttttctattctgttccatagtttgaaccttaacagaaagactatttattcaaccaataattaaatttcaaacataaattatactcagctaaaacaagtaaacccaggatttaccatttaagatactatttggaaataggttcaaatatgaaatgctttccaaagcaggatcatattgtagcacactc

SEQ ID NO: 78011 - DNA, 455 bp, Homo sapiens
agagaaatggaatgaaaaatcttcaaagctggaaggacaaagggagtttcctgttctaggatgtgatgtgaagggaaattagaagatggactgtcctgaagcatagacatgaccctctccaactcatcatctgagatcagctgtcctggtaggaacccctccagccaacccttcctcaagttatatacttctatctactggaaaattgacattaatgcattttcccaagtctcatggaagggtttcacagcttagagctcagcctcagagtggactagcacacagctgtttcggagactggaggatagcctgctgggatagaggtttccctggaagatacagagctgtgagccaatcccaggcaattctgcagagcatcccatctgatcccacacatttgagaatggatggactaacctgaagtattacagagcagcagtgcagaagtggggaca

SEQ ID NO: 78012 - DNA, 332 bp, Homo sapiens
tttacttacatcagtattctttaaacgtgagcaaatcccacatggctcccacattgctatttcatttgtgttgaccaatttataatgattactgttggcctagtattcatatgcctaatactgtgaactgtagaaatctttggtgatactggcaatttctatattagaaccacaaagtaggttctttgcaaacccattttctttttcattaagaggtataaattatttgcaagaaaaaataatttattcttcaagataagcataaactgaagcatatccaagccttttacttgaactctgagcccgaataccctagctaactcattcagttc

SEQ ID NO: 78013 - DNA, 860 bp, Homo sapiens
atggatgcattcatttactcattcatccaacatgcatttgatgttggtaaccagttaatatctgaaagctgggggatataaactgaacatagagtcccatctccatcctcaggaaactcatgccctccggtgatggggggcaggacaaatagcagagagaccgccttattttacaagatgtcattgttctctgagaggctgaaaagattttctatcaccactagcctcctcctctccacggccatttacagaatgggcaaaccagcctcccagcggaagaccaagcttgctagcggtcaacgttgccggcagctctgcaagcgcttccagcgggcgtcgctctcctttcgggggtggtactttcattcggtcatcctgtgagtgttccacttcccgacggaggccgagcactcacaccgcggcggaggtacccgtcaccgcagaaccgggtggctggctctcctccagggagaaagcctgtcacttattcctcaacactgttgggaagttacctagaaaagtacagacagaagacctaggcttgcgttttagaatcgtggagtgttagcgctggccaaatcgttggacacaatgtaagcttgatcaggaaaatgagctccagggtctcacaggcggggcctggaatcttggcgcaatctgcgaccctcactgcctcctacagtcggggctgagcgttctttcaaacagccaaagtaatcacttaagtccagcaatgatctccttggagaaatcaaaagatcctccctaagagacggccttggagggcatcgcccctggggctgggcacagcacgtcttcccggccccggcgcgggaggagggtttggggacagcggccgc

SEQ ID NO: 78014 - DNA, 534 bp, Homo sapiens
gaacttcagtatgcctggatttgggtggggttgccgtgggggagtagtcctggaactaatttcctgcagataatagagatgactgtattggctagggtttcttttcctgtgaattggctgttcaggtccttttccatttttaaattgttttctctactgctttctgtgagctagctgtctctttctgtgagctagctgtcatattgcagtatagcagttgctttatgaaaggtgggttcaaagtaacaagagcacaggaggaggtcagcactagacccgagtcttgaaaggttgggtgagaaggagtctttaaggttttatgagctatgctaacaacttttgactcctaggtcaaagagccactttaaaggagaggaattacaattgtgttttaaaaattatggtaagctgggcatggtggtgtgcacatgtagtctcagctactggaaatgttaaggcaggaggatcgcttgagcccagaagttcgaatccagcctcggccacatagcaagtctcccatctctaagagaaaaa

SEQ ID NO: 78015 - DNA, 506 bp, Homo sapiens
aagaaagaaggccagatctgatttatttaggaagaacagcagtcattgggaccacgattacagttgtacacacagcaaagggaaacgtgacagaaagaagagagtgtatgattatgagtcagaaagattggattgtttccaaagcaaacataaatcagcatcaaaacctcatcatgacgatatcaacttctattctgaaagaaaacaaaaccggccctttttttttgcctgtgtaccggcagactcactggaggttatacccaaaaccattcgctggactattccccctgaaaccttaaggaaaagaaacttcagaattcccctagtggcaaagatttcaagttcttggaatatatggagttcctccaaaaagttgttggggtcgctctcggggtcccttactaccgtttttcatagctgacattaccatagctaaactcctctgaagtggacagctggtcgctattgtgatattctgtgaaaaatacaatcatataacatccaat

SEQ ID NO: 78016 - DNA, 850 bp, Homo sapiens
tagtctacacatccacaagccaagaaaaaaagtagggtgtaattatttaatctagattccacagtttactataattaactgtatccttagtaggcaattcacagtctatactgcacaacagtgaaatcattaagaaatgaattctaagcattcgagaattatatatttggctaataaaaatatggggtgggtttctcaggtgaccagaaaagtactgtaacttcctgttaatgaaaaattcacacaaagtagaaaagtatcctcaggggattgcctccaggatacctccttctcccagaggaaaatcctcagatgctcaagtcccttataaaatgtggtgtcatatttgcatgtaacctacacacatcctcctacatagattacttacaatacctaatacaatgtaaaagttatgtaaatagtcgttatactgtattatttttgatcatattatttttgttgtatatactttttttcccccaaatattttccatctgaggttagttgaattcaaggatgcaaaaatccttggacaggaaggccaactgtgcttaacagaagagcaaaatgctcccaacttgtattcattacgttatggtagaacaaatgatccaaaatgtcttattcttagagaagcaagagacttaaaggtatagctgtcggctgcctcaaaacacttaaaccttgtatttagaaagggcctaagaaatcacctgattcggccaggaacccggtggctcacacctgtaatcttagcactttgggaggctgaggaagaaggatcacttgagctcaggagttggagaccagcctgggcaacatagtgagacgttgtttctattatttaaaa

SEQ ID NO: 78017 - DNA, 574 bp, Homo sapiens
tcctgcattccgccccaacccccggccccccgcggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaaaaaaaaaa

SEQ ID NO: 78018 - DNA, 1426 bp, Homo sapiens
ccaagtattttcagccccagccggccacacagctcggatctcctcctgtggatccccccagctctgcgatgatggcagaagagcacacagatctcgaggcccagatcgtcaaggatatccactgcaaggagattgacctggtgaaccgagaccccaagaacattaacgaggacatagtcaaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaaagccaggtggggcaacagcggtggcagggcagggggtggtgggccagactggtccccgggggacttcttcacaggggctgctggcgagctctttctctttagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttgcgttcacttgtactgtaacaacataaaccagcacgcggttcccacccggggccaacctctccacgcgcactcaggaaagtgaccagtgaccactggcgttaggaaggtggctccagtaaagggttttggctgcatttggggaatgctgcattttgttcgtgcctgtaagattggtttgtgtcctgaccagctccaaaaatatacttcactgccctgaaaaacagacacagggagagttggttgtctcttcacttggccaaatgtaagtgaagaacagagtctttttcttcttcggattctattgtttgctggaaccgtacacgttccttggaagatcatgtttaagtgactcctgttgcctgagcacaaaaatgggcaccaatggaggaaaatgacccttgggctggcaggggcagtgacccttccagggtaccactgagggaagggcctgggttcaagcctcccggaacctcccctttggctaaccgagcccctgaaatgcccagtactgccatttgacatgagggtaccttcgccctcaggagatgtgacgaaggaacaaggtctaatttgtgcgtgtgtggactcactatggaaataaaatgcagtagaaagagcatgtaaaaa

SEQ ID NO: 78019 - DNA, 1330 bp, Homo sapiens
ccaagtattttcagccccagccggccacacagctcggatctcctcctgtggatccccccagctctgcgatgatggcagaagagcacacagatctcgaggcccagatcgtcaaggatatccactgcaaggagattgacctggtgaaccgagaccccaagaacattaacgaggacatagtcaaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaaagccagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttgcgttcacttgtactgtaacaacataaaccagcacgcggttcccacccggggccaacctctccacgcgcactcaggaaagtgaccagtgaccactggcgttaggaaggtggctccagtaaagggttttggctgcatttggggaatgctgcattttgttcgtgcctgtaagattggtttgtgtcctgaccagctccaaaaatatacttcactgccctgaaaaacagacacagggagagttggttgtctcttcacttggccaaatgtaagtgaagaacagagtctttttcttcttcggattctattgtttgctggaaccgtacacgttccttggaagatcatgtttaagtgactcctgttgcctgagcacaaaaatgggcaccaatggaggaaaatgacccttgggctggcaggggcagtgacccttccagggtaccactgagggaagggcctgggttcaagcctcccggaacctcccctttggctaaccgagcccctgaaatgcccagtactgccatttgacatgagggtaccttcgccctcaggagatgtgacgaaggaacaaggtctaatttgtgcgtgtgtggactcactatggaaataaaatgcagtagaaagagcatgtaaaaa

SEQ ID NO: 78020 - DNA, 708 bp, Homo sapiens
ccaagtattttcagccccagccggccacacagctcggatctcctcctgtggatccccccagctctgcgatgatggcagaagagcacacagatctcgaggcccagatcgtcaaggatatccactgcaaggagattgacctggtgaaccgagaccccaagaacattaacgaggacatagtcaagactggagaaaatggaaaaagagaataccccggaggaatctgaagctctcaaacacttctgataacatcctgctggttactgatcatacctgttgatgaattccaaaagagcagttgctatctcaaaggcaagcaaggtcatggagggcaggaaaagcacaaccctgaatgcagaacgagcaccaccagggtcttgaaaccttacaaacaacttcataaatcctgcactgggcttccttattgaccacacaggcttcctatcaaacatgaatgaagaggaggtggactgtattacaaaattaataatgtaagatggtggctgccaaagccattcataatcgtaattgcttttgcatgtgttttcttgaaagcaacttcatatttgtcagcaactaggaatgaaggcgcttcctttgatacttatatgtacaggcacaaaatagagttgaactttgctgcacacaataaatgtgttgtgaaaatacgtgtttgaagtctaataaacagacttttattttgcccatgtt

SEQ ID NO: 78021 - DNA, 514 bp, Homo sapiens
ggcttttataattcttaactttgtattttagaaattttgtatctgatgtataagatcagatcataagcctaaagtagcctaaagtatcagctcaaaatccacatgcctgatggtttccttcaaatgctgcctctgtgggtaggaagcacactctgattccactgagcctgtctctgcacggaacgaacacaaagttcggtagtcacaggacacccttgccgtgctgcataatgatgtctcactctgtccccaggtggctttaccaagccacatcactgacgtattcattgtagttgactcagaaccactagggcacttctgtgatcacagcagtcccatgcaggaagctttaccttcaggaaagctgctggattgagactggagggaagtgtgactgcctgtgcatgaagtgctgagatgagttcttggcctgtggtctgtgcttgtatacattattattatcatttaatgtatgtattttcttatgaagttaattatttgccaatttttcttt

SEQ ID NO: 78022 - DNA, 672 bp, Homo sapiens
agcgggttccggctcttgtcacgtggagggggaccaagggaggtgattgtgggggttggggactagggcaaagtcgggggtcccgggtccggggttgcgccgggagggtactggccaggcccgacttcaagcagggaggtggcccgggactggctcccgcgctggtcacgcaccggggtccgtcatctcgaccgggagtcgctgtgccactctaggggcttaaaaatgccgccaacaactttacccctgctgaggaacttctcgcttcgtttcttagccagttttccaggccttctcccttgagagtctccttccgctcgcccaccctgagcgtaggaggtgggagcaggacggaactggagtggattccagtaactggacttctaaaccggctcggtgtcgtcgcgctctgtagcggacgcttgtgctgggaagcgtttgcagtttataaattacttaggagtactttaaacatctcacgcctgctgtaccacagccatgtgggggtattcagaacaggtattaaggccgttttgcagaccattcatcactcttggctaaaagaacttaacggagtcgcccaaggtcacacagctggctcgtggtaattggggaccattctttgattcataattttgtgcttttggcaccctgaaaaagtaaggtcagatc

SEQ ID NO: 78023 - DNA, 537 bp, Homo sapiens
gatcagatctatttgcaacaagttcctcctgtttctttagatatctccattttgaagtgcttgtctttgtggtgccctctgcaggcattcacatggtcacccattctgggatcagtcattttgtcctgggtacatagaagatctttggtgctaatgcaaggaaaaggtacttttagtagtcacgttggtgtttcatagaacatagtcagatttcactgggcctggttgccaggattatgtgagtaaatgccaaggctctgagaaattgtggcttgctgtactttgaactctggctccacttgctctcatctttgtctttgaactgtgctgccagtgttggtttctttgaccttggcctgaatataggaggcctaggacgggcttcagggtcatcagcactctgcctgatcatgttaacaggaaggcatccttccttgggactgcagagaccagagagtcggggtgaaggttcctccaaaggtggagatggtttctgaaatggagagcattttcaaaacttcgaaaatattttctttg

SEQ ID NO: 78024 - DNA, 393 bp, Homo sapiens
aaaaaactaaaaaagggatatttcatgacatatgaaaatttcataaaattcaaattttagtgtcgatgaataaagttttattggaacacagccatgtccacttgtttacatattttctgggactgctcctgtgcagagtggagtagctctgacaacaacctcatgggcttcaaagcctgaagtatttactctctggccctttatggcataagtatgccagccctgagtcaaatgacaatgtgctggtcattggtgaccagcaattccaaccttgggattcctcatgtattctgagcaggggactgggcaggggcagggatggactctctcacctcttgttcccacacgccttcctgcccttcaggcagtccctccccggtgatttctctgtat

SEQ ID NO: 78025 - DNA, 256 bp, Homo sapiens
catatataagcagtcacaattttatttaacaaacacaccaacaatatgtgatttgtgggaataagaaaaacaacatgaatataaaataatgaacaatttgtagcaaatatttttaaataattgcaattaaagagccctaagactttgtattgtttgggcttggtgttagtaaactttatattttatgttaataatgtttattagaatatcaaaattgcctagcaaaagaaaactgataatgtgaataatttccaaa

SEQ ID NO: 78026 - DNA, 444 bp, Homo sapiens
tgtgactagacccagcaagcatctactcccacccaccgaggccctgcatctgaagcagataggaataaagacctgaaacaaaagagaaactccaaaagatcagctaaacagcagcaggtaagaagagaaaatcagtgatcagaatagtgaaatgaccaaacatgcagtgtgaaggaaaggaaagccaagcggggtggctcctaatcccagcacttcagcaggccaaagcaggaggattgcttgagtccaggagttcaacaccagcataagcaacacgggaagaccctgtctctacaaaaaaatttaaaattagccacatggtggtgcatgcctgtagtcccagctactcaggagggtaagaaagataggatcactggagccgaagagcaagactccagtgagctatgatggtaccactgcactccagcctgggtaacagggtca

SEQ ID NO: 78027 - DNA, 783 bp, Homo sapiens
ctgtctctcagggcatccaggctgcttatagagtctctttacctacatgctccactctcctgctttttccagcagaatttcagcctgcacgtagctctggtatcaatgacacaggcctctactcaatctaaaatttctcaggaaaatacatggtgaaccccaagaccagtctggattcaaaccagttgtcacagtgggaatggggtcattcgatctgcatgcatccctcatacatctggagacttcgttaaggttccagagttactgactgagatttctgagcttttttccccttttctgtttggtttcagagtggagagcagcccaaaaatatgcaggtaactgaagccaggaaactgatttgtgttttggtttggccggatcttaaacagaagggaggtggagagatctgagattagaggacggggctttataggagccaagtatggggcctgcacacacaagacacacacgcacacttgcaaacacgccacacgacacatatgcctgcatgtgtatgcacacacatgcacacgtgagctcccaaacacatcgctccttggggttacactaggtttgtttccatctggcttgaggctatttgcaggcgagagtgcagagtctgtaatgaacctcccagattctctgacgaaggggtcccctaggttcccatctgtcagatggcatggggtgttgaaatgtggggcactggactagatgatctcaaaggtccttttaaaatccttttaaaaacttttctgaaggactgtatgtaaaaaaaaa

SEQ ID NO: 78028 - DNA, 501 bp, Homo sapiens
ctgtctctcagggcatccaggctgcttatagagtctctttacctacatgctccactctcctgctttttccagcagaatttcagcctgcacgtagctctggtatcaatgacacaggcctctactcaatctaaaatttctcaggaaaatacatggtgaaccccaagaccagtctggattcaaaccagttgtcacagtgggaatggggtcattcgatctgcatgcatccctcatacatctggagacttcgttaaggttccagagttactgactgagatttctgagcttttttccccttttctgtttggtttcagagtggagagcagcccaaaaatatgcaggtaactgaagccaggaaactgatttgtgttttggtttggccggatcttaaacagaagggaggtggagagatctgagattagaggacggggctttataggagccaagtatggggcctgcacacacaagacacacacgcatgcacccatgaggatcgtctagatc

SEQ ID NO: 78029 - DNA, 984 bp, Homo sapiens
aaaaaaaaaaaaaaaaaaaaagcgccacagatgattctgacgccctacccagtggagtgctgctactaaagcacagactatcctgctacatgattttcccatctgtacaatgactgaaatagcacctattctatgtggtagatatgagaattccatgaagtaatataggtaaacatttagttcagggcttggcatgtggtaagtgctcagtaagtgtataatgattggtaaacttgttattctgcattcaggcctcaccagggatgacatacggttctctgcctttgaatgtaagtgtccccagggcaatctcaggcaagcctgcaaacccatcctgactctcagtgtttttttgccaatctggatctctttcctgagctccaaatcaactcattcctagatagctcaccctccagatttagggacatcgaactcagtatgtctaaagctgagccttaccatctgcccctctccaaaccgcctctatgacattctgtcttagagaattagagctacctggtttcccaagtgcccaagtcagaaacccaggcatcatttatttttaataaatgttttattttggaataaatttggttttacagaaaagttgcaaagataatatggtgtccttataccccttattcagtttctgtaatgttaacatcttctatataccacagtatgtttgtcaaaactgagaaaccaacattggttggtgtattagtattactaagctccaggctttattcagattttaccagtttttccactaattttcttctgttctaggatataatccaagatacaacattgcatttagctgggcatcatttttatgccattctttatctcctgtctctacatggccaccaagttctggcatttctacatcctaaatcttttaattttattataattttttattgttgtttttcagagacagggtcttgctccagcctgggcgacagagtgagactccgcctc

SEQ ID NO: 78030 - DNA, 1542 bp, Homo sapiens
aaaaaaaaaaaaaaaaaaaaagcgccacagatgattctgacgccctacccagtggagtgctgctactaaagcacagactatcctgctacatgattttcccatctgtacaatgactgaaatagcacctattctatgtggtagatatgagaattccatgaagtaatataggtaaacatttagttcagggcttggcatgtggtaagtgctcagtaagtgtataatgattggtaaacttgttattctgcattcaggcctcaccagggatgacatacggttctctgcctttgaatgtaagtgtccccagggcaatctcaggcaagcctgcaaacccatcctgactctcagtgtttttttgccaatctggatctctttcctgagctccaaatcaactcattcctagatagctcaccctccagatttagggacatcgaactcagtatgtctaaagctgagccttaccatctgcccctctccaaaccgcctctatgacattctgtcttagagaattagagctacctggtttcccaagtgcccaagtcagaaacccaggcatcatttatttttaataaatgttttattttggaataaatttggttttacagaaaagttgcaaagataatatggtgtccttataccccttattcagtttctgtaatgttaacatcttctatataccacagtatgtttgtcaaaactgagaaaccaacattggttggtgtattagtattactaagctccaggctttattcagattttaccagtttttccactaattttcttctgttctaggatataatccaagatacaacattgcatttagctgggcatcatttttatgccattctttatctcctgtctctacatggccaccaagttctggcatttctacatcctaaatcttttaattttattataattttttattgttgtttttcagagacagggtcttgctccatcacctaggctggagtacagtggcacgatcgtagcttactgcagtaagttcacttgaactcctgggctcaagtgaacctcttaccccagcctcccaactagctgggactagaggggtgcaccactgcacccagctaattttgtcaaaattttttgtagagacagggtctcgccatgttgcctaggctggtctcgaactcttggcctcaagtgatcctcccaccttggtctgccaaagcactgggattacagatgtgagccactgcacccagcctaatctttataaatctccatccccattactctggttcaccccctatcgtttcttagactatttaacagcctcctaacttcactctacttttaatctcttccctctccaggtctttctccatattttaaaaaactagtttcaccatccattcctctctgcccttaaaactttctggtggttttccatggcttaagagaataaagcccaattctttgatttgacatgctaggcattccataatcctctccgaacctaactccccacttcctttccctcctttacacctcataaagcctgtgttccaactaaattta

SEQ ID NO: 78031 - DNA, 1267 bp, Homo sapiens
actagaggacgcctccataatgtgtgccaggcaatctcaggcaagcctgcaaacccatcctgactctcagtgtttttttgccaatctggatctctttcctgagctccaaatcaactcattcctagatagctcaccctccagatttagggacatcgaactcagtatgtctaaagctgagccttaccatctgcccctctccaaaccgcctctatgacattctgtcttagagaattagagctacctggtttcccaagtgcccaagtcagaaacccaggcatcatttatttttaataaatgttttattttggaataaatttggttttacagaaaagttgcaaagataatatggtgtccttataccccttattcagtttctgtaatgttaacatcttctatataccacagtatgtttgtcaaaactgagaaaccaacattggttggtgtattagtattactaagctccaggctttattcagattttaccagtttttccactaattttcttctgttctaggatataatccaagatacaacattgcatttagctgggcatcatttttatgccattctttatctcctgtctctacatggccaccaagttctggcatttctacatcctaaatcttttaattttattataattttttattgttgtttttcagagacagggtcttgctccatcacctaggctggagtacagtggcacgatcgtagcttactgcagtaagttcacttgaactcctgggctcaagtgaacctcttaccccagcctcccaactagctgggactagaggggtgcaccactgcacccagctaattttgtcaaaattttttgtagagacagggtctcgccatgttgcctaggctggtctcgaactcttggcctcaagtgatcctcccaccttggtctgccaaagcactgggattacagatgtgagccactgcacccagcctaatctttataaatctccatccccattactctggttcaccccctatcgtttcttagactatttaacagcctcctaacttcactctacttttaatctcttccctctccaggtctttctccatattttaaaaaactagtttcaccatccattcctctctgcccttaaaactttctggtggttttccatggcttaagagaataaagcccaattctttgatttgacatgctaggcattccataatcctctccgaacctaactccccacttcctttccctcctttacacctcataaagcctgtgttccaactaaattta

SEQ ID NO: 78032 - DNA, 468 bp, Homo sapiens
tcccgcttcagcctcccaaagtgctagtattacaagtatgagccactgcgcctggacgaaaattcttatttctaatctacatgctttacaactcttaaatcaaacgaaagttttaaataaggagaacaccaagggaaaaataacaaagactctaaggaatggcagctaatttttcttcactgatcaaatttctacagccacaaaggccaaatggcccttcaaatttcatttgaagaataaatgctgtgtcattgaatgttatatcacacactggactgttatctcttatgctggctaggtatcttttattctaaccatgatttatttaaaattaatgtgaacaaaaattggtgggtttttaaaaacaggaaattttaaaaaatgttttattccttttatttatatgaccgtatgttatggaattccacgtaagtatcttagatgtgaaaagacacttacataaataaa

SEQ ID NO: 78033 - DNA, 621 bp, Homo sapiens
  misc_feature (260)..(260): n is a, c, g, or t
cccaggttcaagtgattctcctgcttcagcctcccgaatagctgggattacaggcatgtgccaccaggcctggctatttttagtagagacggggtttcaccatgttggccaggctggtctcgaactcctgacctcaagtgatcagcccacctcggcctcccaaagtggtgggattacaggcgtgagcacctggcctgttaatactttaattagttgtactcgttttggagtctaagtgatagtcctcccaaatactcttnatcttttgctagaatagatgaaatgctgatcagctctcctgatgttagcactctcttccctaaaggcagtgatttccgcacctctatctcaagaattccaggtactgtgaggacttcagggattcttggaggctgaaggctggttccaggggttctggactggatacctcccacccctattcagtcaagtactctgctgattgataagtggattctgagattttattgctatatttaaaagagtttgaaaaccagtggtatagaagaaagtgttcattgtttagatctttactctgggagcaggaggaagtaaggagttcgagaccagcctggccgaacgtggtgcaaccacatctgtact

SEQ ID NO: 78034 - DNA, 368 bp, Homo sapiens
aggccagcattactttgataaaaaagccagggaaggaaaaaaagtataagccaatatacctgatactgtctcaacaaattaggtatggaaggtgtcttggtttgttttctcttgcttataacagaaactgaaactgggtaatttatgaagaaaagaaatttatttctcacagttatggaggctgagaagtccaaggtcagggtggtctatctggtgagtgccttcttgctgataggaactctgtagagtcattaaccaacatagaacatcgcatggtgaggagctgaagatgctagctcagatctctcttcctttttttatgaagccaccagtcttactcccatgaaaatccgttaacccattaattg

SEQ ID NO: 78035 - DNA, 1424 bp, Homo sapiens
atggatttccttcacaggaatggagtgctcataattcagcatttgcagaaggactaccgagcttactacacttttctaaattttatgtccaatgttggagaccccaggaatatctttttcatttattttccactttgttttcaatttaatcagacagttggaaccaagatgatatgggtagcagtcattggggattggttaaatcttatatttaaatggatattatttggtcatcgaccttactggtgggtccaagaaactcagatttacccaaatcactcaagtccatgccttgaacagttccctactacatgtgaaacaggtccaggaagtccatctggccatgcaatgggcgcatcctgtgtctggtatgtcatggtaaccgctgccctgagccacactgtctgtgggatggataagttctctatcactctgcacagactgacctggtcatttctttggagtgttttttggttgattcaaatcagtgtctgcatctccagagtattcatagcaacacattttcctcatcaagttattcttggagtaattggtggcatgctggtggcagaggcctttgaacacactccaggcatccaaacggccagtctgggcacatacctgaagaccaacctctttctcttcctgtttgcagttggcttttacctgcttcttagggtgctcaacattgacctgctgtggtccgtgcccatagccaaaaagtggtgtgctaaccccgactggatccacattgacaccacgccttttgctggactcgtgagaaaccttggggtcctctttggcttgggctttgcaatcaactcagagatgttcctcctgagctgccgagggggaaataactacacactgagcttccggttgctctgtgccttgacctcattgacaatactgcagctctaccatttcctccagatcccgactcacgaagagcatttattttatgtgctgtctttttgtaaaagtgcatccattcccctaactgtggttgctttcattccctactctgttcatatgttaatgaaacaaagcggaaagaagagtcagtagagtggtgcctagagttagtgctctgtgtcacagatcacccttctccatccaccagtagagccacagagtaggcacagaccagaggcttctaatccgacttcacagaatagcggcacaggccccattccccatagagatgtttagtttggccttcgcactggtctttttttttaatccttcagttaccaatatttagatacaagaatatttgacataaaaatcggaagttctgtatttcttgaaaaatctgatagtatgacaacacagagcctgcatccccagctggagacaactgaccagagctgcatactaacagtccccagtaggaggcaaggactccattttctcacagtctt

SEQ ID NO: 78036 - DNA, 538 bp, Homo sapiens
gtagcagagtattactgctgaccaaataattaaatgcagggatataggatcttagatatataactttggcaaacattctctcaatctgtggttgtcaatctgtgtgcttatgatcttagtctttggtttattaatccatagaagcttttataaaaaaagaactacagctaggtcttaagtatgctcagtagtaagaagtgggaagagctaagaaagagccctagattgaggtagtgaatgtagaatcaactcttggctctgataactttctaaaaaaccttaaatcttttaatttctgtgagatgtaggtgttttgtctgcaagatgggtgaattgctaaccctcatctcacagggtttttttgttgtgaatattaagtaaaataaagagtatgttggctgggcgccgtggcttatgcctgtaatcccaacactttgggaggctggggcaagtggaccacttgagcccaggagtttgagtccagccgtgatcgcaccactgcactccagcctgggtgacagagcaagactctgtctcc

SEQ ID NO: 78037 - DNA, 403 bp, Homo sapiens
catccacagaggcaggaagtggatttgtgtttaccaggagctggggatttggagagatggggagtgacagctaattgggtatgaggtttcttttggaggtgacgaaaatgttcaggaattaggggtgatggtcgcacaaccttgtggacacaggagaaaccactgaattgtacactctaaatgggtgaactgtaggatatgtaagttatgttttttgtttttttgagatggagtctcgctctgttgcccaggctggagtgcagtggctcaatcttggctcactgcaacctctgcctcccgagttcaggtgattctcctgcctcagcctcccgagtagctgggattacaggtgcccgccaccacgcctggctaatttttgtatttttagtagagacggggtttt

SEQ ID NO: 78038 - DNA, 590 bp, Homo sapiens
cactttaggcaaaaagttttaagtattttttaacaatgggcccttttatagatttattaatattaataatatagcatttattacagaaacattaccaagaactcctcagtgccatcaaggtattattatcatgttcatatatttttattgcctttctttctgtatttcatattttatgcaaatataagtcttagttatctagtaggtaaaactgataatatgcttctggagagtctgcctaatgaaaaagtaaaaatctacagccttttaaatggatatgaaaatggaggaaataggccaggtgcaggggcttacacttgtaatcccagcactttgggaggctcaggtgagagcatcgcttgagtccaggagtttgagaccagtccagacaacatagtgaggccccatctctacaaaaacttgaaaaaaaaaattagctagcatggtggcgtacatctgtagttccagctactctggcagctgaggtgggaggatcagttgagcctgggaggtggaagctgcaatgtgccatgatcacaccaccacactccaaactgggtgacagagtgagactttgtctcaaaaaaaaa

SEQ ID NO: 78039 - DNA, 176 bp, Homo sapiens
caaataagattgatgcaagcaaaatgtttattttagactctggcacatggtaagatttgttacattattccccaggtgttaaagatgaggctgaaggtaaggagcagagggaaaatgcattgattaatggcatactaacaccatttgctaactttctcataatgggaaaatgttga

SEQ ID NO: 78040 - DNA, 371 bp, Homo sapiens
actgtaacaaatgtaccactgtaatgtggattgttggtagttggggagggtgtgtatgtttggggacagagagtatacaggaaacctgtactttctgctaaattttcctgtaaacctaaaactgattttaaaaataaagtttgttaattaatagaaagttactccagaaactagtaaaatattgcaaaatatatatctagtatctaaactaataaaatattgcaaaatatatatatctgataaagaagttgattataagatatataaagaactcttacaaatcaagaagataaaatggataatatcaatgggaatttttgtgtccttgtatgagaaaaagagttcttcaatacaaaagcacaattcataaa

SEQ ID NO: 78041 - DNA, 187 bp, Homo sapiens
tttgtcagtttcaaatactcatgtatctgattgtcaatgctggagagctggggccagggcagtagttgatgaatatcacctgactgtctcctgcagaaaaagcattcccagaagcacggagaagtgaggagaaaaggcaatgcacctggagctggagaccaaggccctgttcttactgatggccctt

SEQ ID NO: 78042 - DNA, 1666 bp, Homo sapiens
cagtggctcatgtctgtaatcccagcactttgggaggttgaggtgggaggatcacttgagcccaggagttcaagtctagcctaggcaacatggtgaaaccccatctctacaaaaaatacaaaaaattagctgggtatggtgacacgcacctgtagttacagctactcgggaggctgaggtgggaggatcacttgagcccaggaggtcgaggctgcagtgagccgagatcacgctgctatgctccagcctgggcaacagagtagtctcaaaaacaacaacaacaacaaaaaacaaaattaaaatttattttattttattcttggacttgactctgattcctcttttccatgcatttttactctgcacacatgtgtgcatgaatgcatatatgtatttatatagaatataaagccttctgggcagggacctcattttaatacctctttatggcacccttagagtcctgtaacagcccttactttttatttgcttaaaatgaagtatgtgtgtgtgtgttcacgcatgtataaataataggttcgaaatacattgtaatcatgggtagataattaatggtcctaagactgttgacggatattttttccttttagtctgttagtgagtcatcatcatatgccattttattatcttgaaaacagtctgtggaattttttatcccgtgtctttgctgtatgagtgaaccaccacagagggtgtcgggagcaatattaagctggagactttcttcagtgatgcttcgcttatgtatttgcagctgctgccattgtcgcttgttcccatgtgcaggagttggatttttttgattgttgtttggcaagaaatattaatagtaacttttgtgtgtttgattattttcggggccggagcagcatctatccagcacctttgggatttggtggttattgacttaggcacagggcttctaagatcagaacttggttcttcttcccacaagtgctctgttttggaaatgtgctaatgacacacattgaattatgtcagaggtttgtggccttaagttgtcgagggaggtgttttcatttggcgagaatctgtaatttgtggaacaataggattaagttctaaaggaaataggcccgatgaatctgtatagatggctagtttcgcaaagtaaagcacagagccagtgaactgggggcaaactacacgttttggataatgtgagcctaaaaagaaaaaccctaaaacttttaaataaatttctaaaaaccaaaaccttttagtatatgtaatttactggcttaaaactataaatattatagttttaataattttgtagatcaggaatttaggtgggactcagctggccatttgtttccatgtcatgtatccaaagctcactctgtagtatcacctggtagatgggttgacctgaaaggtccaaggtggcttcccttatgtgtctgcccaccttacgggagatgggtgggaagctggctcatctggggctattaaccagaatactggcatttgtcctgtcctctggggtggatttgcccatcaaaacttgaagttctagcagggcagggtagatactcctactatagttccaactacctgggaggctgaggcaggaggatatctttagttcagcccgagcaagctagcaagaccccatctcttt

SEQ ID NO: 78043 - DNA, 359 bp, Homo sapiens
catatcatagtaaaaatgctaaaaaccaaaggcaagactgaattttttttttcaacttttaagttcaggggtacatgtgcaggattgttacataagtaaatgtgtgtcatgggagtctattgtacagatcatttcatcacccaggtattaagcctggtacctattagtcatttttcctggtcctctccctcctaccaccctccaccctcaattaggccccagtgtgtgttgttcccctctatgtgttcagatcattcagctcccacttataagtgagagcatgcagtatttgacttttctcttcctgcattagtttgctgaggataatggcttccaccttcatccatgtccccgcaaag

SEQ ID NO: 78044 - DNA, 395 bp, Homo sapiens
atccgattggagatgaaatttgacatgtgtgacctgactgagcaacagctttctttttaaaaatggccccgtttcccagattctgaagtacagtattttatacttgttatggaaaatcagagacatagaaaagtagaaagaaggccgagtgctgtggttcacacctgtaaggaggccgaggcaggtggatcactggaggtcaggagttcaagaccaacctggccaacatggtgaaaccccgtctctactaaaaatacaaaaattagccaggcacggtggcaggcacctgtagtccctgctactcaggaggctgaggcaggagaattgcttgaacccgggaggcggaggttgcagtgagctgagattgcgccactgcactccagcctgggtgacag

SEQ ID NO: 78045 - DNA, 763 bp, Homo sapiens
aactgtggactcaaactgggctcttgaccaaacagacctaatagatatctacagaatactccacccagaaaccacagaatgtacatttttctcatttgcacatggaacattctctaaaattgaccacatgctcagtcataaaataagcctcaataaatttttaaaaatcacaactatattaagtgtcttctcggaccactgtggaataaaattagaagtcaatatcaagaactctcagaaccacagaggtacatggaaactaaacaatctgctcctgaaagacttttgtgtaaataacagaattaaggcggaaatttaaagaaattcctgaaacaaatgaaaatagaaacataacataccaaaacgtctgggatacagaaaaaacaatgttaagaggagagtttataacactaaatgcctacataaaaagagagaaagatctcaaattaacaagctaaaatagccaaacacactagaaaagaacaaaccaaacccaaagctagtagaaggaaataacaaaggttagagaataagttaatgaaattgggaccaaaaaaaccatacaaggaatcagcaaaattaaaaagttggttctttgcaaggacacataaaaatgatagattgctagttagattatacaagaaaaaagaagattccaataagcacaataaaaaattacaaatgagacattgcaaaggataccactgacataaaaaaagatcctcagaatatgtttgtgtgcataaactagaaaacctagaga

SEQ ID NO: 78046 - DNA, 843 bp, Homo sapiens
accaaatctggtgaatcatctttatgttttgtttttcttttgctgcagactgcaggcagctggagcacaaaatctgctcaaatgtgattctttctgtgtggttactttaaataccaaaaggaaatgttgacttgagcgatgaggcgtaccctgaaaattaactctgtggtttgcagatgcctttaaggttccaatcataagactggtttgtatattagcgtctaggctctcagcagggacactggtaatcaagcttgtgttcccagtcagaaatccaaagaaactctttttcatcagggtgttcaacctgggaagcaaggagtgggtgcaggatccctctgtttctgtttgagcagtggcactccctctggcctctggaatggtaaatctgcaccattgctagcttggctgtttgcgtttgggggctgactagaatccactgtcatacactacttgttcagttcaatatttcttgtgctttaaacaacatttaaacctagatggtagggataagatgattcctgcacttaaagagcctgtgacgtttaggaaacaagggaatgcaaggctcaccatggagggtagaagaatgttacagataaggttgtttggtgttgtaacaaacacacaagatggaaaatctatgttgctgctattagctactattgattgaacaccttcttagtttctatgtatatatagatatatatatatagagagagagagacagggtctcgctatgttgcctagactggtctcaaactcctgacctcgagcagacttcccacctcagcatcccaaagtgttgggattacaggtgagccaccacactggtcctaaaga

SEQ ID NO: 78047 - DNA, 374 bp, Homo sapiens
ggacccttcaccagatggaagatataagactgaggtagagtgtggattggaagagagtggatttcaggggagaaggtatctttggagaaagctatgttatgagctatacaccttggaggcggggtgcctgctccctatcatcaaacctaatgatgaggcttccaaggatacttgggcaatttcatatgttgctcccgcattgaggcttttggtagtgtggctcccaacaggtctatttaaagggcaaaagatgctagctgctgctggtaatgaagccagtagaagagcaatgttgggatttgcctgtacttctaaaaattgttggggctaagggatgtttgtttgccatggaaccagtgctgtgctgaaaaact

SEQ ID NO: 78048 - DNA, 354 bp, Homo sapiens
ctgtattttgttgtccttataacatttatattatttcagttttaagtcaaaaggtattctgaatataataaaagcctcacaaattatttgtaaaatttagtggttcatatttagtatatcagtaatatagaagacatctttatagtcaactcttaattaatgcttattgtaccaaatctttgagatatttgtacataaatgaaatatgtactttcatgctaaaattatatatcatgactgtgctataatttggcatgtcattatctagatttatatgtatgtacgtatttcaggtccttgaaattttaataaatattacagttaaatcctgatatgacatagttaccggctaag

SEQ ID NO: 78049 - DNA, 452 bp, Homo sapiens
catccgtatatatagccgctaattacttaaagcacttgtcatcgtacattaaggaattgcgtaaaatgtttagctgtatctgtaggctccaggtaacttaattttttaattgtattactatgatgttcagtaaatgctgagtgaacttacattctttaaaatacatcaaaagaggctgggtgcagtggctcacacctataatcctagcactttgggaggccgaggcgggtggatcacgaggtcaggagctcgagaccatcctggctaacccggtgaaaccgcgtctctactaaaaatacaaaaattagctgagcgtggtggtgggcacctgtagtcccagctacttgggaggctgaggcaggagaatggcgtgaactcaggaggtggagcttgcagtgagccaagatcacaccactgcactccagccgggcaacagagcaagactccatctc

SEQ ID NO: 78050 - DNA, 371 bp, Homo sapiens
ggccaggacagcttgctctgctcccttcaacttccctaggaacagctgatcagttggggaaatggaatcctctgtagctttggtcacccacttgtttgatggttgatgctggccatcggctgtaaacttggttgggacaggcagcatgaacactgacacaggcactttcaggctctctttgtggcctgatggctctcacaataggggctgggttccaagggaaaacagtctgagatagggaagccacatggtatccctttcactacattctactcattagaaggaagtcagtaaggctggcccatattctgttttttaaataggatgaatgtagcttctcttatgtatatatgtgtcaatttaaaacaaaa

SEQ ID NO: 78051 - DNA, 755 bp, Homo sapiens
gccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggaccatgttccagtaaatgaggactgcagcaggagccgtgagccctgactcccggccagagacacgacgtcagaccagaaagaatgaggaggccgcgtggggcccgcgggtgtgcagggcagagagggaggacaacaggaagtgccccccctccatcctgaaacggagccggccggagcaccaccgcccagaggccaagccccagaggacctcgaggcgcgtgtggttccgagaacccccagcggtgaccgtccactacattgctgacaagaacgccacagccactgtcagggtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttcca

SEQ ID NO: 78052 - DNA, 574 bp, Homo sapiens
aaatggacacagcccaggcccatgtatcattagcagtaagagttggcggggcggggggcgctgttattcacaagaagaaacaaagggaacgccagactttcctcaggaaatcagagtttaagtcaagcagctcaccacaagatcttagcccttggtttctggtcttacctgtcatatttttggtggcattagaaaagataacttggggacttcacatcaatcaataattaattcaaagctcttagtactttccagagaatcacaattcaaatttacattagcccctcttgggtctccagagcagatactgcatcaaaaagtttccaagggtctggtttacaccactttcaaagtaaagcccattaataatggcagtacagaccctaatgcctacccactgataggcgagaagagctgagggatccggagcagggtgcctgatgggaagaggatggggttgaacagagacccactttgattcctgatggctctgccattagctgtggaaactcaggggtgtgtgtgcgtgtgtgtgtcttccttttctttctttcatataaaagaaagcatcata

SEQ ID NO: 78053 - DNA, 437 bp, Homo sapiens
agaaaatgagacttgcaaaaatgtaaaaacaatgctgcttttgtcaaacatttttttttttgccttggaaaagagcattgcttttcataaaaataagctatttgtgttaacgtgtaataaaattatttttattttttaagtaacaaacacatttttaaaaatttagtttcaaatatgataaatattaataagggtttaacagatttttaaaactcttgggaatgtatgaacacaaagaaggaaacaatagtcgctggggcctacctgagcaacggtaggagggagaggagcagaaaaggtaactactggggactgagcttaatacctgggtgatgaaataatatgtacaacaaaaccctatgacatgtgtttacctatgtaacaaaccttcacatgtacccccaaacctaaaataaaagttaaaaataaaaaaataa

SEQ ID NO: 78054 - DNA, 328 bp, Homo sapiens
ttctcagcttagggttatcaagaattgatgaattaatttatgccaatcaatttgcaagtaaatggtttgtaaattagaatcatagtttattaatttctcatgaatgttgcatttaagaatgggtctcctgcattaaatgcttttccccaggtggatagatgtagtgttcagactcaccaacatttaagaacatagtgtgtgcacttgcctctgccatatgatttttcttcatttaatccttccaacaccttttgctgtgtgggaattattgcctcttacaaatgaggaaatagagtcagagaagttaaataccagatcacaccagcgt

SEQ ID NO: 78055 - DNA, 227 bp, Homo sapiens
tggaatatttggacacagtttccggaaggatgagagacctaatcaatggtagtaagatgtttaaaatattattaatacgaatgaatgcttaggcaaggttgacggtaaagctcttctgtacaataggtagcgttaataaagaaatgacaagatttggaaaatcagtatttggaaataatcataattgtttcagccaggaatcatcaaatgatgctaaaacttggaga

SEQ ID NO: 78056 - DNA, 344 bp, Homo sapiens
gggggtggccctccctccctcctcttcccctctcccgtctcccctccccccaacctcctccagcaacccagggatcaagcacacacataatgtacccacgtgttgtacctacgtgtcggagagagacagagagggagacttggacacacacacacacacacacacacacacacacacacacagagcagcaagcagcgtagacccatcaggtttagaaatcgatagacagcgcctctcgtatctctagcgcgtcgtagtccctactatactctcccaagcacgtcctctcaaagtaggtacaggtagttacttttaataatagagagcgcccaatgaactcaacg

SEQ ID NO: 78057 - DNA, 520 bp, Homo sapiens
tcacacgactgcaaggctgaggtctagggtggtggcctggacccctctttcctggaagccatgcttttcctgaaaccccttgcaatactcctggcaagtatggcagttttacctcagttggtatgagtgtactcaaatgggaggcaaccattctcacacttgatgtttagactttgcagcttccaaaacccactctgcatatcacctgctccctcctcaaagtggctgggcttcccatgcagtttcccatcctgcagacggcccagggaggtcagatttcttggccaggcttgcagagttggtgggacatgatgtgggcactagaacccagttctgtaaatcttggtttcatgtcctttctgctgtgtttttctttctctgtttaggcggtggactttttggtgtgtaaagcttctagaatggattttacttctttgtggctctttggattgagggaggggctaggtgccatctccagagaagcttgttcagctcatgctcactcggggcccttgctctc

SEQ ID NO: 78058 - DNA, 460 bp, Homo sapiens
gtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggcctggagtgccagagcgtcacctccaggggggacctggctacttgcccccgaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcaggaactgagggcatatctaaatacctggaagcactttcttagaatgctaagacggagcaagcaagattttctagcc

SEQ ID NO: 78059 - DNA, 482 bp, Homo sapiens
gtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggcctggagtgccagagcgtcacctccaggggggacctggctacttgcccccgaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagcgcgtgcacagcgcgggcggaggcggctccaggtccggaggggttgcgggggagctggaaataaacctggagatgatgatgatgatgatgatggagc

SEQ ID NO: 78060 - DNA, 211 bp, Homo sapiens
aagttcacctggctcctggatataggaaagacaaatcaatggtatgtaaatgactgagccttgagccacatttctcgaaaatagatagaaaatttgctttaatccacaatgaatacccaagggagggccttgcatgttagagggttacttttctaattccacaatggttcaggggaaaaacttaaatctcgaagagagagagaggtggcta

SEQ ID NO: 78061 - DNA, 899 bp, Homo sapiens
agcggggttaaggataaaagactatctatggggtgacaagtgcactaaaatctccgaaatcaccactaaagaatttatccatgtaacccaaaaccatctgtaccccaaaaactattgaaataaaaaaatagtagtataccagtgttgtgacaagtgccttattagtaatatatggtgttaacatcagggaaaactaagtgaggtatgcaggagctttctgtgctatctttgtaacttctctttccttttttttttttttaaagcagtctccaaaatgcagactcattgatcaattttagatatcccgattgtttttggtagaatgaaaagtaaaatcactgcagcactgagagttgcctgacctactttagtgaagagctgattgtgaagggctcttgcttttgcctcattctctggaagatctgctgagccacacgaggggtctctttgtagtttggatactacagttcttggaacgttagttttgtgaaatggcactccactgtgctttgtagagtacccgtggctgagctcgggctactcatgcacaccgagccacgccagcttgcttggggaatctacacctttgccaaggagactctggcgtggggccttcggaatctagatctggaaagtggaaggaggggtggtgtgtttgggttgcttgcccgtacctcttcggaaaagtccactgagctgttctaatctttatgttgcctgtgcccctccttcctagatacgtcatttctcattaaagaatatgcgtattttaatgtttccagtagacattgccaaattgccttctgattttacactcggttctagtccacattcccaccaactttttaggaaatttctatttttctaacctttctcaatgtctgacagttaaatgaaaa

SEQ ID NO: 78062 - DNA, 1631 bp, Homo sapiens
tcgtgaaagggccgcaaaaaggccgaggcgaggttgacggctgcgactccattttgtaggccgcttatttgtgtgcatccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcacgggcgggcgtacctgcggaccaggagcaagctgtgggagatggacaatatgcttatccagatcaaaacgcaggtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatcggtggttcacagctgaggactgtagtcaactggtaaggatgaactgacaccttgaggaaactgaaacagcttgtcattttctctgttttgtttttgtatgttttttacccccatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtgtcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaaaaaaaaaaa

SEQ ID NO: 78063 - DNA, 828 bp, Homo sapiens
tcgtgaaagggccgcaaaaaggccgaggcgaggttgacggctgcgactccattttgtaggccgcttatttgtgtgcatccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcacgggcgggcgtacctgcggaccaggagcaagctgtgggagatggacaatatgcttatccagatcaaaacgcaggtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatcggtggtaaggtcggaaactagctggagcttggatgaaactcagtagtcgccctaagcatggttaaaccgcgccctgtaaaaagttatgttctaggcctgcatcccccattttattgcatcaaaaattgagcattgggaacaaagttggggtca

SEQ ID NO: 78064 - DNA, 1580 bp, Homo sapiens
ggctacccggtgtccgggatccgtgatccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcacgggcgggcgtacctgcggaccaggagcaagctgtgggagatggacaatatgcttatccagatcaaaacgcaggtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatcggtggttcacagctgaggactgtagtcaactggtaaggatgaactgacaccttgaggaaactgaaacagcttgtcattttctctgttttgtttttgtatgttttttacccccatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtgtcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaaaaaaaaaaa

SEQ ID NO: 78065 - DNA, 1576 bp, Homo sapiens
tcgtgaaagggccgcaaaaaggccgaggcgaggttgacggctgcgactccattttgtaggccgcttatttgtgtgcatccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcacgggcgggcgtacctgcggaccaggagcaagctgtgggagatggacaatatgcttatccagatcatggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatcggtggttcacagctgaggactgtagtcaactggtaaggatgaactgacaccttgaggaaactgaaacagcttgtcattttctctgttttgtttttgtatgttttttacccccatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtgtcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaaaaaaaaaaa

SEQ ID NO: 78066 - DNA, 1208 bp, Homo sapiens
  misc_feature (12)..(12): n is a, c, g, or t
  misc_feature (19)..(19): n is a, c, g, or t
ccagaaggacgncccagangacgaccagaaggggcgggaatggacatttgcccagatcaaaacgcaggtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatcggtggttcacagctgaggactgtagtcaactggtaaggatgaactgacaccttgaggaaactgaaacagcttgtcattttctctgttttgtttttgtatgttttttacccccatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtgtcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaaaaaaaaaaa

SEQ ID NO: 78067 - DNA, 1332 bp, Homo sapiens
tctccctcccacgctgttaattagagaaagataacagtaacttcggtttagtttttgtgaaacataaaagtcaattctagtagggcagtcgccagaagtagacctgtctaggcactaagggagtttggggaaagccaaagaagacctaggccatagagcacagtggaacgcaggtgagaacgcagggaaagagaagtaaagagtaaagccagaggccattacctgaaatttccagattgttctatgagacaggtatgtcagaggaccgtgtctcaaagaagtggcattcttctgggtggttcacatttatttttaacatcaggatatggaactttgagagtcaatgtcttcatggtaaatttctcccaattgtgctttaggttcacagctgaggactgtagtcaactggtaaggatgaactgacaccttgaggaaactgaaacagcttgtcattttctctgttttgtttttgtatgttttttacccccatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtgtcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaaaaaaaaaaa

SEQ ID NO: 78068 - DNA, 882 bp, Homo sapiens
caaatggttctttttttccggagtagtaagttccaatatgggagattactccgaagcctggtaggataagaatataaacttcagggtgaccgaaaaatcagagtaggtgttggtcggaagtatgtagtcacttcaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtgtcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaaaaaaaaaaa

SEQ ID NO: 78069 - DNA, 200 bp, Homo sapiens
ccattttttgtgtcctgttcaattttttcatccctatttttacagttttcattatagcgatttttttacttctttggttaaatttattcctaggtattttatatttttatagctattataaatgggattgctctcttttttattttattcttgcattgctataagttttttagattgctcgctgttagcatatagaaata

SEQ ID NO: 78070 - DNA, 567 bp, Homo sapiens
agaaaacggtataaaaatatgtatatgtctgtggggtgatgttccttaaacaagacatagatccatgttctttaaagaaaaaaaatctctacagatttaattatataaaattaatctattggaagaaaatatttgcatacatctgatagaagaaagtcttgatgttactaatataaaaatactcctacaaattcataagagaaaagaactacctaatagataaatgaacaaaggatttggataggcaatttaaaggagaaattacaaatttgttgaaacattcatttggaatattattaggttggtgcaaaaataatcgtgcttttgccatttgacagagggagtaaattaacatatatgataaacccactgtatgctaggtactatgaaaagtggaatatatcttctcatttaagcctcaaaactcattttacaggcagttaatgctaatttagccattttacacataaggaaattgaggcttaatgagtttgactaactcttccaaagtcatgcagtccaaaagtggcaaagctagcatattttctggagatgtattgtacagca

SEQ ID NO: 78071 - DNA, 918 bp, Homo sapiens
agcggggtttcatatccagtgataccgactttcaagtagtcatgcttcaccttattgtgtttcacagatactgtgtttttcacaaatggaaggtttgtggcaaccctgcctctagcaagtctgtcggagccattttcccgacaacgtgtactcatttcatatctctgtgtatttggtaattgtcacaatatttcaaactttttcattatttattacatctattatggtgatctctgatcagtgatctttggtcctgttgaaattgtcctggggatccacaaactgcactcatgtaatacagcaaacttaaaaaaattttaaatggtaagttcaggggtacaagttcaggtttgttacataggtaaacttgtgtcatggtggtttgttatacagattatttcatcacccaggtattaagcctagtacccattagttatttttcatgatcctctccctcctcccaccctctactctcagaaaggccccagcacgtgttgtttccctttatgtatccatgtgttctcatcatttagctcccacttagaagtgagaacatgcggtaatacagcaaacttaattgataaagtgtacattcagactgctccagtcactggctgttctcttgtctctctccctttcctcacgccaccccaatctctgagacaaaacaatattgaaattaagccaattaataaccttacagtgacctctaagtgttcaagtgaaagcaagaattgcatgttcttactttaaatcaaaagctagaaataattaagcttagtgaggaaaacatgtcgaaagccaagatagactgaaagctaggcctcttgcgccaaacagccaagttgtaaacacaaaggaaaaattcttgaaggaaattaaaagtgctacttcagtgaacacacgaatggtaagaaa

SEQ ID NO: 78072 - DNA, 277 bp, Homo sapiens
gcctctaactccacggctcaagtaatcctcctgcctcagcctcctaagtagctaggactacaggtgcacaccaccacacccagctaattttttttctttttgatttttggtagagataaggtcctactatgttgcccaggctggtctgaaactcctggcctcaagtgatctgtcttagccttctgagtagctagaactagttttaatgaccaaaagaattatgtgttcacctgtgattttatgtgttttgttaagacattcagaatttagagaaatg

SEQ ID NO: 78073 - DNA, 1236 bp, Homo sapiens
gggaccagcgccccggggggcctgcagcacagcagggcctgccctcctgggtgagactggccggtgcctgtggggatctggggggctacagtcagggctctgtgctcccgagggccacgccagcccacctgccctggaacagaacccgaggcttctgcctaggggagtacctgggcacctgcctcctgtgctgccctggacacatcccagcggctgcacataggggaggcacagcctgggctcagggccagggtccactctgtggggatactagacccgggggtgacaatgccagctcagaacttccccccacacctgggctcctccagcctggcctttcctggggaagggagggcctgtccttcctcagcactgtgggagggaggcaaggcctgcggttgaagcgtccccaacacggggctccaggagagaaagcaccacatctcagggaatgaaaacagagacggggccgcccagtgcactcggtggctcggaaatcattaaagaatgttctgagcccccgattttggctgtaaaagggactggccggcttgtgaccgctcccctgtctgtgccttgagacgggagtgttcagcgttgggggcagctttccctccaagaggagcttcacaaacatccgctctctgcggggccgcctctccgtggcctggggccgctgtcggaggaaggctctccagctgccgtcatctgggaaacgtggggggcgagcaggggtcatggatggggctcactggggactgtgagaatctgtcccgcaggactttctgggatggaaacgctggcagaggtgaagcctgcgtcatgtgcttcactgaacccggctgcttatttatgttcggagggctggtttcaaggactccacgtctccctctccagtgatagcgtcagcggaaatgcagacggggacggggctgctgggtttcctccctggaatgaagcacagccggaggttttgctgattcaccagcaggccctgaccgctgagttcagggtaacaaatccacatggatcctgagcccgcatagctccctgggcctcagcataaacatcgtaaacctccgggccctggcagtgtctgtttcatcccctccagagcaagtgcaagtgtgagatttagagattctaagaggggaagggccagaggtcttgaaaacgaccttcattcgttcattcattcgagaagtttgcgagggcctccgtgtcctgcgtttagtg

SEQ ID NO: 78074 - DNA, 703 bp, Homo sapiens
aggtagagagagtgggctccacagcatcccttctgcactgcaggttgtgggagaaggtggtagaagcattttgagaacaggttggcatcatcacataagcccttatattcaagaactctgcaagccaacgattgccctccctgctgaacactctagggacccttttgccagtatccatcatcagactgttctagaacgcttgtctgcaacagccccaaactggaaacaacccatatccatcaagtttatccagcagggtggacaaataagcaacggtatattcatctgtggaatattacgtagcagtgaaaatgcatgaactatggctacgtggaacaatgtggttatatcttggaagcatcctgatgtgtagcaattaatggcacctcagtggggtcctccacagtgtggctcacacatttattgacagcctaaaacgtgccaagctctgtagacagagagtgaaagctcagtagaaggcagtggttagaggcacacaccctagactcagatgcgggatgaaatcctgggtcagcccttaacaggttacgtggcctgcatccatacaatctgtacagtggcctccagagagcatcccctcactgtggagtgaggatgaaaggggagtgtgccgattaaatgccccacatggctccggttcatgaggagcagttcaaacatcagagatttttatcaacaagga

SEQ ID NO: 78075 - DNA, 368 bp, Homo sapiens
aacaaaatactttcctcatccaactcactgattaaacccttaccctgttaactcaccctatgactgtgtaaacctccagtaagattattgaaggcacagctccaagtaacttgcttaattgcattcctgggacaaaagagggaagcgcttcaaagctgacagacagatggtagagtgtccagtcacagcaaagcaggccccgaggctcatgacagacaactccagggctgagatctcatttgtagctctgggataaagtccagggtttgatggcagcaggctgaagtgtaaagatgctcaacaatgcgcaccccagagacactgaatctgaaaaagcttagagtgaataaaaatctggaaatgaactc

SEQ ID NO: 78076 - DNA, 352 bp, Homo sapiens
aagacaattggcagtactcagttggaagtgcttaattgttaatatatatcagccgtggttcttcagcgtcgtcagtgttgctcagtcttgctctttgtggcgactactgaatgcttgaaaaattctctcctatactcccactctgcactgtagaagagaaagagaggagagtggaagaaaaaagagagggagaggagaaagaaagagaggagagagaaacatgggcatggatgatacataaggtagttgtaaactgtgatcagctttgataataactagataaattcttttaatacaaaaatatataaggcattttgcctttttttcaaatttcaaataaatggatttgtat

SEQ ID NO: 78077 - DNA, 373 bp, Homo sapiens
ttctaaggatgtaaggaagccttcgccttttatgttcctctaattttactgcatgatctcacagggaaatgagtggagcaagtggctcatcagccaccttggcctctgaaaagaattgtcccagaagccatctctctatcaaacctggctaatttcttctctcctccttcagctctggcctcttcctgctcacctctgccaatctcctttccttccactcaaagtctggccacaacaaaaaagaaagcaggtttggagagaggtcagtatgctgggttattgtcaaaggagttatgtgtgtttgtgtgtttctgcaaaagtgcattctgctgctgctaaattgtcattccatacactatctacattggaaaga

SEQ ID NO: 78078 - DNA, 508 bp, Homo sapiens
gaaactgcaggttaaagggtgaaaagcagttgcgaagtccccacagcttggaaatggtggagccgagactgaaacccaggtgtgctagcatctaaagttcatgctctttccaccacattagactgtattctgagggcaccaaggaagctccatttttcttaagaaaccaaattgcagtcctccaggaccacagccaggggagcatcttcgtgggagagtggctgctgctcagagttgtgactcccatccttaagagtcctctgtcctctctggcctcctttctactgatcattgctgtccccttcacaggggagaggggccatggcctatcccctaaagagtctgccaaggtagactcataacctccccgtggcacagctcagacaagctgggctatttacataagacttgacccagggcttgaggacagcgcgaggaatgaggtgcagaggagactgctgcttctgggtgacagtctgcctggctgaccacagctggggtactcatt

SEQ ID NO: 78079 - DNA, 294 bp, Homo sapiens
atcaaatacatcctttaggaattcctttaatttggtctcttgttggcgtatgttcagttttcatttgtctattaaatgtttatcacttttttcgtgataggttgttctgctgggttcacaattttaggttgccagttctgtttttttgtttgtttgtttgtttgacacttggaagatattattctagtgtcttcaatattctgtctttggtctttggtcattctaattaccttttctttgtatatgatctgtcccttctccatggcttcttttaaaatcttctctttatctttg

SEQ ID NO: 78080 - DNA, 480 bp, Homo sapiens
taggacgatagttctcaatcctggcagtgcactatatagaactttgaaaaaaaatattaatacagatatccaaacacagacccactggatttaatactaatctaacacagagccactaaattaggacctctacggtcaggactaagcatgtgtattttttccttcacgtttaaataaccttttttatttcaagatagtttaagactcacaagttgcaaaatagatcagagttcccctgtacccttcatccagcttccattgatatcttacataatcctggcactttgtcaaagctggaacactggcattgaaacaatactattaactcaggtacagaccttatgtacacttttttcccccggcatagagttttatgaaatttatcatgtgtgtatattaatgtgccatcaccacaatcacaacatggagctgttccatcaccacaaaggaactccctcgtgttaccccttagctgtcact

SEQ ID NO: 78081 - DNA, 264 bp, Homo sapiens
gctgggcgaggagatcaagatcaagatcaccaacatgaccttccagtacaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctccta

SEQ ID NO: 78082 - DNA, 383 bp, Homo sapiens
gagagacctgcactgaatacagtggtttgataatgatcaccttatggctggcagatgagccaaggatgtagaagagcatgcccaaggagggtctgcagaatgagaggaggcaacaaccaagaccagagcacaagtgaacaccagcattaaaacatttacaaagaaaactaaaatgaacctgaggcagagaagaacatctgggatactggtgttgaagtcaagagaggacagtatcaagtcaggtaaataaagattgatttgtcaaggaccttagttacttaaaaagctaagaaaaacataggttaaacacttcaaatgaatcatggatttgttctctaacaatgttttcatattatacaatgttgatgcaatctttctttttc

SEQ ID NO: 78083 - DNA, 811 bp, Homo sapiens
ttgaattcagcagaactttataggaatgcaagctccatggatgcaggaacttttgcatcttttgttcacctagtacaatgcctggtacatagtaagcacttaatacgaattgtcaaactgatgattgaacatcaacaatgtaattattgatgcttatttcaaacgctctttctaaattcataattatcttgttctaacaaattctttttctataagagatgtctatcactgtaagaaaactaaaatagaaaatttaaatttgaagagtgatcatttatattagaaaaggattcaattttaaaattttctaatccttccaaaaacactttctggtgcctttaagtggttgcttacaaatcattactatccaatcagaccaacagattagaaacaagaatccatgggtggttccattagggaacaacttttttggatagttgattagtatattgaagtaatctattgattagtttattagtatatctgagtaatgcacaagacagaaaaatctcaattttgaggaagtattatcttacaaatcataatcattgatatcctaatggataaaatactgatattttatccataatttgcttatggataaggataatattctcctctgatatccttatgaataaaatattttttaagtgttcaggagagtagccgggcatggtggcatgtacctgtaatcccaggtacttgggaggctgacgcaggaggatcacttaaacccagaaggcggaggttgcagtgagccaagatcacgccactgcactccagcctgggcgacaaagcgaaactctgtctc

SEQ ID NO: 78084 - DNA, 842 bp, Homo sapiens
ggaggctgaagcaggagaatcgcttgaacccgggaaagggagattgcagtaaaccaagatcgtaccaccacactccagcttggatgacagagcgagactctgtctcaaaaaaaaaaaaaaaattcatgtgacaattgtatgattccacttatatgaggtacttagaatagttaaattcacagagacagaaagtagaacagtggttatcagaggccaaggggatggaggagctgctcacggcgagttattgcttcaagggtacagagtttcagtttgggatgataaaaaattctggagctggttgggagtgatgattgcacaacagtgtgaatgtacttaatgccactgaactgtacacctaaaatggttaaacagtaaattttatgtcaaatatattttaccataataacatttttaaaaattgatgggaaatattattttgcaatggaatagttgcaagttgtttgttaattgttcaaaccaccttggtacttgctcatttggttgagggagattagagggaagaaattgcaaaagatgttttgctagtgtgtactacaagatttcagatgacttgttgcctggtatagtagctgcacttctttaaactttgctatactgtatatacagccaggaatgtttttctcaaggacatggcagctacctctttgaaataaaatcttcaagggagatagttttcctaactcttacttttgtgggagggtaggagtctaacttcagtgggtatcttgctccaagctgcaaaactgcctcctgtcttagagatatgaaacatctgtttcttctttggataaagccaactagcaaacaaagaccacccc

SEQ ID NO: 78085 - DNA, 685 bp, Homo sapiens
agacaggaatggatgaaaagtgaaaagacaaagatttagccatttggaactcagttttatcttggaaataatagcatgtttacggccagatccgtccagctaatgtttatctacctagttaagtaagaaatgtgtttacttacacttaagaaagctgaacactagtagaaataatagtcaaacttcagaaagtaattgagtaagagttgagaaattggagacacctagaatggactataacaaccttggagataatgggaaggaagtaacgtacttttcaagattaagtctgataaggcagagaacccagcatggagcattaagaggaagaaaaatagtagaggaaagaagggctaagattaaaaacagagataataagcttttgaaatgaaaacactttattctttaagacagactgaggaaaaagggtataaaatatgaaatgaaaaaggaataagagaactagggataggactgttcatttgagcacagtagaatggttccaaataactaacatgcagaatgaaacagatcaaaaagataaaaattaccaggaaggaacctgcataaactaggaagggaaaatgttaatttgtactagaaacctctcaaggcaggaaactgatgaaactctagcaacgctaggcagcacatgaagaggaaacaaaagcagaagaaatgaaca

SEQ ID NO: 78086 - DNA, 195 bp, Homo sapiens
tttttaattgaaaatacaaaatataaaataagctatgtatttgtttttaagcaaccataaataatttgaacataaactatgggataaaatggttatggctctcaaatacttagtgagatttcagtgctttacttatgaattaggtttgatggtatagctcggcctgcattgctcatgtctttttttccttttatt

SEQ ID NO: 78087 - DNA, 318 bp, Homo sapiens
tagatttcacatataagtgagattacatagtatttatctttctgtgtatgacacttcagttagcataatgttctccaggttcatcctagttgttgcaaatgacaggatttccttccttttaaaaattgagctggaatagtggctcatgcctataatttcagacctttgggaggctaagactgcaggattgcttgagggcaagagtttgaaaccagctaggcaacatagtaagacctcatatctaccaaatataaataaataaataaagtagctaggcatggtggtacatgactgctgaggcaggaagatcacttgacc

SEQ ID NO: 78088 - DNA, 387 bp, Homo sapiens
gactgaggcagaagaatcacttgaacccgggaggcggaggtcgcagtgagctgagatagtgccactgcactccagcctgggcaacagagtgagactccacctcaaaaaaataaaatacaacaaaataaagaactctgattaaataagcttgttgtgcttttcttttgttaacctgtcttttgttacaggagtgttggctgtgctccttataatgagtgaggaaaggtgtgatgcctttctgcccctccacggctcacttcttaacaaagttcattctgtttgggggtaggttgaacttttacaaaagtttttccttatctgagtcacaatgctgtttctccatatatcctactcattgactcttgttctattttctggagcacgaag

SEQ ID NO: 78089 - DNA, 311 bp, Homo sapiens
accagccacatgtcaaaagctcagtagccatgagtggctactggctaccttactggacagcacagctatagaacatcattgcagaaagctgtgttggacagtgccagtctagaaacattctacccaagctgtgataaattattagcgttatgatgaaattaataataaagaatttcaaagccaccagtcagtgagtctcccctaggtgcccagcccacagtgtcctatctgagcctgcaggggcacctgaatagtcttcaacttcaaagtctattgtaaaaagagggctttttttgggaaaaaaaaaatcc

SEQ ID NO: 78090 - DNA, 241 bp, Homo sapiens
aactaaaggtgaagggaaaactaaaaagttgggtttgatgaaattgtggatatctttggggatgtgacttttcactcaagttgtgagaaaaaaggaaacacccttaacaaaagcttcttctggagagaaaaagccacagtccatagagacatttgacctcaatgtctttcacaaacaaacaagatgccacagtggttacttagtgaacataggtatagtaataattatataattaatgatc

SEQ ID NO: 78091 - DNA, 476 bp, Homo sapiens
ttggatggatttccagtacagtggtgagtagaagtaatgatagtatcattaccttgttgctgatctcaagaggaaggctttaaatatttcaccatcaggtatgatggctactctaggatttttgtttgtttatttgtttgttttttatagattttctttagcagactaatgaagttccctttccttcctaagaggttttttatttaaaaaaaaaattatgagtgaatgttgaattatatcaaatgctttcatagtttgttgtggtggtggttgtttttgagacagggtctcactttgtctccaagctggatcatggcgcattgcagcctcaacctcctgggctcaagtgatcctcccacctcagcctcttccagtagctgggaccacagcacatcaccacacccagctaatttttaaaaaattgttatagagacagggtctcactgtgttgtctaggctggtcttgaactcttagg

SEQ ID NO: 78092 - DNA, 471 bp, Homo sapiens
ttagagaaagtggatattagatgtgggaggagtgggggtcatgatctgttgtccagtgtgtccttatggacagatgccccagcccagccacatttacttactccggcctctgccttcctgtaggactcagcttatagctacatcaccgctctgcctaatgggagcactgatgtaaccagtgctccttattttctctgtaaaatattccagcccctgccttcaggaagctcacagactctctctctagcatgcgcacacacacttctcacacctgggttgtaggcttcaccagcatccgctgtgtgcgcttataaacctgtaaatgccagttgcacatactgttgttaaataatttaattataagctatgtaaatgtttgcagtgtgaatgtgaaaaccaagatttgtcatttctacaaaagaagtagaatgtttagaaagatatgatattaataaaagttacttttgcaaa

SEQ ID NO: 78093 - DNA, 301 bp, Homo sapiens
tttatttagtcttccagctcttttatttagcatccaggtgctggatgatacttatttacaattcctaaagaaagtgtttttggtaatgctgatatagcagtacttaccttgttatatatatgtagttggcatttggttcctaaaaagtaggatgtaggtatttactgtgtttgagaaattctgattcttttcactagatatatgctatttattcttgctggcttatacctatgttcatttatatgctgtaaaaaagtggtaatttacaatgtaaaaataaaagtatgcatatacaaaaaaa

SEQ ID NO: 78094 - DNA, 7625 bp, Homo sapiens
agccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacggccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatgacatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttggaaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctaataggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagga

SEQ ID NO: 78095 - DNA, 7358 bp, Homo sapiens
gctgcatcctactgctattttcattttatagatggaatactttgaagcacgaaaaatcattatatcttgaaataatttttaaaataatccaataacaaactcagaactactgaagaataataaagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacggccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatgacatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttggaaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctaataggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagga

SEQ ID NO: 78096 - DNA, 5974 bp, Homo sapiens
ttcagggaaccaatcttccgccttcaaggcaaattgtacgagctaagttctgtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacggccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatgacatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttggaaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctaataggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagga

SEQ ID NO: 78097 - DNA, 2622 bp, Homo sapiens
gctgcatcctactgctattttcattttatagatggaatactttgaagcacgaaaaatcattatatcttgaaataatttttaaaataatccaataacaaactcagaactactgaagaataataaagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacggccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaaggcgaccccctcctgcagttccaggacgaccatcctaacccccatcattcatctccttttgtttccaacaacatgtctatccatggtatttaaaagcttttcatttgcactatatgtcgtatgtacataaaaacttttatttttcatccatgtgtataataaaaacaaagtttattctatataaaaatgaagtgtgttctgtttctttttt

SEQ ID NO: 78098 - DNA, 2936 bp, Homo sapiens
gctgcatcctactgctattttcattttatagatggaatactttgaagcacgaaaaatcattatatcttgaaataatttttaaaataatccaataacaaactcagaactactgaagaataataaagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacggccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaaggtaaggcatggagcagaaattgggggggtagtgcgccttggttctcttctcatagaatgacagacaaaatttatttgaaagagaaaattgcaaagatcttatcgtacgtgtttgcagttttcacaatgaacagagactataggaaaattgccaaccctgttatgccatttaaaaatcacttgtgatcattgaaatttctcatttatcaattggcacagactaaataggactaaagaacactccgtcccaatgaatgacattttggcagctattgggagaatttgagggctttgaaacaaaagagctatggaggattgtagcaagctgtgtgttctataggtcatgagagttccatggactaaagtctgctctccttataaagattctgaaccctgtttagattttccctgcctcgactggtcttctcattcacttcttgcgtaacgggtgtaaacaaaaaaaggggctaatccggcccccccttaagcagtaaaagcggcaagaagcttgcctgtccacgtttg

SEQ ID NO: 78099 - DNA, 537 bp, Homo sapiens
ttcagggaaccaatcttccgccttcaaggcaaattgtacgagctaagttctgtaagctttactgttgctttttcatttagcttcccaagggcacagtttgtctttaactgattaactcaactagcgcttgctactaattttttttaaacttaggttgtcttgtccgtaacaccctatcattgaaataaaaatcctcttaagagggttcatcccttcactgctaataacttgctgtgattgaaaggtatgaactagtaaactctaaaatgctgtaataataaacccttaacactgtgggtgctttgatatttctctaattttaatggtccttaaaataattaaaatcattaatgatcttcatctctgtccttttatgctatgttgttatgaggtgtaagcctttctcttccccttgtatggtaatatttccaataaatgtagatgatgcttctaaaaggtgggtaaatattgagtatctgattttgctgtgtttgttgataagcctacccaataccaattatttgcatttatttaaaa

SEQ ID NO: 78100 - DNA, 602 bp, Homo sapiens
cgcccttgagtcatcacaccaccagaaccctcacaaatataacttacaacccactctggctttggcaagcacaggagactgatgggcccccaggaagttgtgaggcccctggagatctaaccaccagcatgggctaccaacaagggagtgcagcctaccaaagtccccttaggacaaagggaatgtggatgcagcactgattgctgaaggaggcagtgccaacaccaggaaatgaacatggagagagggacatctcccacccatccaatgccatacactattgcagacacagcagaggttcttcccactgggggctggggaatgcattcggagaaagcattttttaagcttttcacagcagctccatccctactcaaagtaagcccatgctgcatggggtttactcgaatggcggggcctaactcgccctccctacacagaatggcagcatcccagcaacagagaacagagaaatcacagagttgcctgccctgaactggggtaagatactctgtccaagccttcaagagggtgtttcggtggcccacagctgctctgcaaccaggaaccaaaagtatttatgaactaaggtcgtgagcttt

SEQ ID NO: 78101 - DNA, 396 bp, Homo sapiens
aaatgctgttatgaaaatgggtatacaaatatcccttcaagaccctgctttcaactcttttgggtttatagttagaaatggtcttgctggatcatgtggtaattttatttttaacttttcgataaaccaccagctttccataacagctgctccatttacattcccaccagcagggcacaagggttctgtctatttctccatatcctcaccaacatgtattttctgctctttcgatagtagtaagagtgtgaattgatatctcattgtgacttgcatttctctaatgactaatgatgttgagcatcttttcatgtgcttgttggccgtttgtatgctttctttggagaaatgtaaattcaagtcgtttgcccatttaaaaattttgggttgtcttct

SEQ ID NO: 78102 - DNA, 362 bp, Homo sapiens
tgtatatatctcattaaagaactgtaagatgtcatacaaatataaagtcgattggataagaaagattgaattatctatttataccaattggtttttctttgtatgtacaattagccctctgtatccgtgagctccacacctgtggactcaaccaactatagatcaaaaatatctgggaaaaaaaatatctgaagtttcacaaagcaaaacttaaatttgctgcccactaatttgtatgctgaatccaagggaatgaaattatgtgtaggcattgtgttaggttttataagtaatctggatatgatttaaagtttatagaagaaaaaaatgtataggggaagaggtgagtaggttatatgcaa

SEQ ID NO: 78103 - DNA, 3207 bp, Homo sapiens
gtcgaggtgctcatagtggagccctggctcccgggcggacggagccgcacggtagtagatgggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcgggtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcacggcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggcaccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattcttcgtaac

SEQ ID NO: 78104 - DNA, 3133 bp, Homo sapiens
ctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcacggcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggcaccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattcttcgtaac

SEQ ID NO: 78105 - DNA, 502 bp, Homo sapiens
tagaagaacagactcttaagcgatgacactgttgtcttgaaacttgactctgttcagcaaaccattgcagtgtaccctcagtgctatgcatctctgcagtgtatagctgctgtgtgttatcaggagtcatttggaagtaactggtctggttgaacaccacacagaaatctttactaattagctagctatctctaactttggtttgtgacttcggtctgtgaaatctatgtctctctcttttttttttccctgatagcatgtggagagggccaaatgtgaactgtgttgacagcactggctacacacccctgcaccatgctgctttgaatggccataagtaagtatcaatgtactacattcctgccttcacccttcagaacccaggccttcacgttgccttttcatttcctagaaaagtttgctggctgagcttagtggctcatgcctgtaatcccagcactttgggaggccgaggtgggaggatcacatgaagctgagtttg

SEQ ID NO: 78106 - DNA, 857 bp, Homo sapiens
aatttgtttatctgtgctgtgtagatggagatgaattgtttctaatttttagctaatacagataaagatactatgaatattcatgtataagtttttatatggacatatgcattcttttcttttgagtgaattcctgggaatggaatggtaggtagattttttttactttttgttttttattttattttttgttttttatttttttttaagacagagtctcactctgttgtccaggctggagtgcagtggtgcaatcttggctcactgcaacctccacctcccaggttcaagcaattctcctgccacagcctcataagtagctgggattacaggagtgtgccaccaagcccaggtaattttttaatttttagtagcaatggggtttcaccatggtggccaggctggtctggaactcctgacctcaagtgatccacccgccttgacctcccaaagtgctgggattacagacgtgagccaccacgcccagcctttttttattttttaagaagctgctaaaaccgttttccaaagtagttattaacaggtaattgaataacaaaattgtggtatatctatacaatggaatactcctcagcaatatttgtgacaaagtggatgaaccccagaacaattacgctatgtgaaagaagccagacaaaaaagaatatattacacttattaaaagttctgaaaaatataagtgctgtattgcaatggaagcatatcaaatgcagaggagacaacaaggaaagggaggaaaggaattcaaagggacaggaaagatttaggaggttcactatcttgatgtgatgatggtttcacaggtaaatacacatatgtccaaactttttgagttg

SEQ ID NO: 78107 - DNA, 423 bp, Homo sapiens
ctcgcaggccgaggtgggaatttgaccttgtttcttgagggtctctgggaggcaagtcaggtctgagctttccaaaacacccttcaggctgctatatggagaatggatcggaggctcgggggaggcccaggtggggggctggggcaaagccgacagggaaggaagaggggaggggtgattctggagccttggggtggctgagcaggcaggaccagtgaccacctggccctgacgaggagcaggggcttcctcggtttctggcaggtcctcacctccactgtctgctctgcccattcagcctcctccccacctgtctacgcccccccccttagagaccccacccctgttctccattagcctctcaaggatttggggggttggggtgctcttctggctcaataaagacttcctggttgacactca

SEQ ID NO: 78108 - DNA, 1728 bp, Homo sapiens
ggccccacaatccccttctggctccggggacgggcggggcggggcgagcgggcggaaataattttctgtttggtcgtctctgccccagtcccttcgccgcgggacgcgcgagacgggagaaggtgcgggaagcgggaagcaggagcgggagcgcgcggccctggcacgcatagggcggcggagagggcacgagcagggattgagcacctactgtgtgccttcacgctttacaaaaggattttcgttcgatgttcactacagcccctgcccgggggtactgatgccccatttacagagggacaagccggatttcggagaggtgaagtcactcgccgaaagtcgcaccgccagggtctgcgtgacaccctaaagcagtgttcagttaccccggggagagcgcgatgaacttgaaccacttgttggctggttcctgctcttgctcgttttttgcggatcgacacatagtgggcgctcaggaaaataaatgttggaagcttgagattgaacttgacagctcgaccctaggtacccgccacgaatccagcccagcccgcggggcaccgggtttctccagacctcgcagggaacatttgcggatgggctggtagaggaggctcggacatcccagttccgcacccgcactcgaccaacgcgtggtagcggaacccctgtcgtagcgaggcacagactgggttcaagtcccgactctgccgatttcagcctgagtgactttgagcgagtcactttttcccgtcgaaacctcagttgctccatccacaaaatgggaaatatgaacagccaccctaaaacggtgtggggaggattaaacgaaacaacgttcccaaaactctaaacttacaaatgttgtctcccgtccatcccataaacttaggcgacaaacctggcgcagggtgacctgagacaaaggcttcccggcccctgtctccaagtcgtccatccctggggcgtaggcacgttttagtgagccctgtccggcgaaacccgaaactgcggccaccttggcagcggtgggccccaaaaggaaatattcaaatattctgaaactcgtgcatgatttaggactgacatttttacgtttaattttcttgcagttttattcttgctagtaaaggtaattcgttagaaacccttaagtgcagtttctcctctgtgtcttgtttaacttttcgtgttagcgaaattcacaaatttgaccaaggaaccggagcgcggccgtcctcgccgggattccggtcatcgcaataatctggctctcggcccctactcccaggcacggaggtcgaagagacgggcttcccctacaccgccctgtgtagatgtagcctcttcgtcccggcagccctccgagattccctgtgtccaccggagcgaggagaggtgtggggctgcagcccagaactcagcttcctggacctccccaaactcccgcctctccgggattaagggagtaaatccctgacgccaaagaccaggtcaaggacaagttctcccccgccctactcccccctcctgggcggggattcatctcccttccggatgaaaggtactaaagagccgacggggggccgcggcgggccccaggcccttgatgttccggttgaacaggtgctggtgaaaaggaggcggacccggcggaagagtctgccagggggcagtgcgccgaaggggaggcggcctcctccacccccagtcccccggcccgtcttc

SEQ ID NO: 78109 - DNA, 326 bp, Homo sapiens
aaaatatttccttatttctcttgtgacttctttgatctgttgattcttaaaacgtttgtgtatttccaagtatttggagcttttctaacattcttactgttattgatttctaatttaattttttttaatagatagggatcatcctctgtgtgatttcagtccttttaaatttgaaacttgtcttttggctatgcgtagtctgggccaaatgaactacatgctcttgaaaagaatatgttttgttattattgaatgtaatgttctataaatatttcgttcaagatgattaatagcattgttcatatcttctgcatttttactgattt

SEQ ID NO: 78110 - DNA, 4474 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaatgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgacagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacgtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 78111 - DNA, 4547 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccagacaggtcattaataaaatgttctccaagagcctgagctttttaaagttgtatatctccagatagatggcttgggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaatgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgacagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacgtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 78112 - DNA, 4430 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccagacaggtcattaataaaatgttctccaagagcctgagctttttaaagttgtatatctccagatagatggcttgggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaatgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgacagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacgtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 78113 - DNA, 4456 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagtcaatgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgacagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacgtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 78114 - DNA, 4669 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaatgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgacagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacgtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggaaaaaaaacaatgagggggacgctaaaaatatgcactggaaggggacaaagttaacggcgtaccaggtttggttacaaggggctcgaatgtggagtgagttatacgactaggacgggccgaggaaaaaagagggacggaacaagcggaggcgatggagagaccagctgtggggacactggacagcacagagataag

SEQ ID NO: 78115 - DNA, 1305 bp, Homo sapiens
ggtcaagttggcgtctggctcaaagaagggcgctcggggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaatgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgacagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacgtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 78116 - DNA, 3679 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccagctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 78117 - DNA, 736 bp, Homo sapiens
ttgaggatccccaaccctgccaccgacggctccatttacgagatggccgacgaccccgacgtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 78118 - DNA, 2849 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcgactaacgatgcggccaactatggggggatctctagagtaaccca

SEQ ID NO: 78119 - DNA, 1863 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaaggtgagctgggcctcccacctgcctgccctcacctgcctgccctcacctgtgctcctgcccgtgcccctgccccacgccacccacactaggtggcagtgttctctgagggaggggaggcct

SEQ ID NO: 78120 - DNA, 1003 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggctctccgtccaatggggaagcacagcccctgcttttgaggagctccgagtctgatggggcagctctaaccatccttgagcagcacagagcgcaatgggagagacacacagacaacacggcaaggcccgagggccccagagccacactcctgactcctgtctcaggaacggggacacctgggccaaggatatgcttatccctttagcaagcctgggatgtgcttggagcacattttcctgtttgtagctcacttgagtccagggagcaatggattcccactgtattaggaggcaaaggagtctcagaaaagtcccagagctgggaggtctgagcggctgaggggcctcagttgttgtttaacccatttggcctatttcccacctgaattcaatcaagtcactaagtccc

SEQ ID NO: 78121 - DNA, 290 bp, Homo sapiens
cgagttggcctcctgcgtggggctaaatgtgcagcctcagtgaggctccaggacttcttcagtttctcttcctctggggtgctgtgattcctataggatctggtgtggcttttggggagccagtgtgctgtgtggtgacctcattggcctcctgaaccctagaacctgaacatgactgtggctcaagactggtgcctggccctgcagaggctgatgcgggtgaaggaggaagagatccactcggccaacaagtgccgtctcaggctcctgcttcctgggaaacccgacaa

SEQ ID NO: 78122 - DNA, 953 bp, Homo sapiens
cgccattgtatggagagaccacattttgtttacgcgttagtctgtcgacggacatttttgcctccacattttggcgactgtggctaatgctgctatgaacatggctggacaaatatctgtttgagaccccgctttcagttcatgtgggtctattcctagaaagatccatgcttttgttttctttttcatgcattagctgtttcttgaggtcttgttctgcatctggtgccatctgtcctggcctcaggccgggccctttgcagacccagtgtgtgtagggggttgcgcagggtgaggctttgccccaggctggggtagagttggtcatgggtgggctgctcagtctctgctctgacctggcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaaggtgagctgggcctcccacctgcctgccctcacctgcctgccctcacctgtgctcctgcccgtgcccctgccccacgccacccacactaggtggcagtgttctctgagggaggggaggccttgctcttccaaggatgtgaccttggggattggatcctcagcgggacccccacgttcattcctgttcatgttattttaagataaaagttcattttgtgcatcagtgtgatttccagtaaagtctccagaaatcaaagcctagttaaatgaacaggctctggagagtcagaatctgggtttagatccagattttgccataggtgcttgctgtgtgccctcaagggaatcacccaccctctctgaacctcacttgctccctttgaaatgaggagcatttaatagcaccggagccctagg

SEQ ID NO: 78123 - DNA, 436 bp, Homo sapiens
gaatgcatcatagtcattaagctgtagcaatgggcaaatgatagcatgtggcgtttggcttagcttggagcaagaggaagaaaggaaaccaacttagtggtggcaatatcccaagaacttgccacatttgcatgatcatctctgccatagcagcttataccttgaaggcttccaaagttgtcctgtggagcaaaaggaaggaagagagatattggtacattctttaagggatggaaaaagtcatgaagaagcccagaggtcgtttgaaaatgcagtcatgatcacgagttgcatgcctggccttgttattgggttgtatgagctcttttgcaaggcaccagaatggtgcaccctgcagctgcagcttatctactgattgagaccctaggacacaaggctgcctgcctcatgttccccatgcctagggattaggtac

SEQ ID NO: 78124 - DNA, 428 bp, Homo sapiens
ggcacccaaccatcgcggttttgctgttggccatcatatgcatggtggatctgccgcccagatcactgggcgtcgtatcacaagtgctgacaaggaaacatatataccgttgagaagcttaagcttcccaacgcgccttgcgacaggggctgcggtattgcatccacatgactgataaactagtaaacacacatgaattcattttaaaagtgtattcaatcagttaggtaaactaaaaaccttaagtcttcgttcgatttggaatgcagccagagaacaaatggaaaatttttcaaggtagagaagatgaaaactcagaacgccctcttgtggcatctctacccaccctaggaacactatggctcttcccctacacatggtgattgctaaccttgctacaagacgttgagaagcttgggccgagtcgg

SEQ ID NO: 78125 - DNA, 681 bp, Homo sapiens
tattgctacactaataggtgtaccgattagggcacccattgtgtgttcaactataaatagtggcaattacttagtaagtaatgcagcagactgctaaactgttaatccgatttaactgactaggcacctgaactatcaggaccaggatcaattgcctgctaattaactattattttcatttaaaaaaaagcatgtccatgattgattgtctcatatataactattttattccattaaaagataaataagccaagcagagaatattccttttgggaataactggctgctgctgatgctttatttccccaatttaataaaatgtatctgccatcctttcttactgataaaaaggaaaataagtgatttccagagcatccttctcttcccagtattcctgccttaattatctctcaggactctgcatacaagcatccaatcaactgagttttgcagcctgtaaattaccttcacacattcctacctttacttatttctcctgacctgcttggcttatcgtctacccttttttcacagtgtaactcacatatttcagagacacatgaattcattttaaaagtgtattcaatcagttaggtaaactaaaaaccttaagtcttcgttcgatttggaatgcagccagagaaccgtcgattcgaggggatactctaggtcgcctcgctc

SEQ ID NO: 78126 - DNA, 3184 bp, Homo sapiens
aatcctcaacaatgagccctggaaagccactagtactgattcacagctgaaactcattcatcatttgtggatcaaacaattcctaaaaaccctttcagccctgaagataaaaattctggcctttgagtcagggtcttcactctgtacttctaaccttggctccggggtattgccgaaaccagtccaggcacgtcacaaatgtctgacttctcccagaggcttcagaagcacaatgagcagcagaggagagccatggagccaagcacagtctcatttaacctccccaaaagcttgggaagtgggtggtgttatagccccattttacagatgagaaaaactgaggcttatttaagcagctcacctaaagtcacatattgattgtgctgagctgagattgtaccctaatctgccttcaaatccatgtttttacccattgcatgtgattatggaacctgggaccgaggagcaggaggagaacattctaaattctgctcccatcttgtctttacatctcaggtcacttttagcaaagacagacccggacacttgccattaatactacaggcttccttcctcctacccccttcccccaatcttattcatctcacctctccagtaggtcgtggactcatgcattttataattaaagaaggccaaggctcaggggttaagtgacttactggaggttatcagagaggaagttgccaaacccaggctaggaactgaatggttggtttaaatccacccctctggcaggagactggggaatacacatgagccgtgcagacagcagagggcagtcctgggggtgggggcgccagagggtttccggtacttttcagggcaattgaagttccggtcactactcccccccagagcaataagccacatccggcgacgtgtggcaccccaccctggctgctacagatggggctggatgcagaagagaactccagctggtccttagggacacggcggccttggcgctgaaggccactcgctcccaccttgtcctcacggtccagttttcccaggaatcccttagatgctaagatggggattcctggaaatactgttcttgaggtcatggtttcacagctggatttgcctccttcccaccccacagttgccccccaatggggcctcggctggctcacaggatgagggttcaagaagaaggctgtccctggaggtaagagggcttatgaaccatgttccaaacctttgcgttgcttttctttccatcgtgtctatttcataacatccctgtgaggctggatgtgggaacttcagcactgccgtactcttgggaaatttgtccaaggccacccggctgagcagcggttgaaccaggacaccatcaggcatgcgtttcttgtctccaccacaccctcaacccacttcccaacgcgccttgcgacaggggctgcggtattgcatccacatgactgataaactagtaaacacacatgaattcattttaaaagtgtattcaatcagttaggtaaactaaaaaccttaagtcttcgttcgatttggaatgcagccagagaacaaatggaaaatttttcaaggtagagaagatgaaaactcagaacgccctcttgtggcatctctacccaccctaggaacactatggctcttcccctacacatggtgattgctaaccttgctacaagacgttggacacacacacacacacacacacacacactgaggttccttttgccccctcactttgagccagtgactactgaaaccctctccattgttgcaccaccagcaatgcccccatcacttcctctcatttacttccacaggctggttcatcctcaaagccctccttacgtagatctgtgggatcagtgaggctcagagaggtaaagtggccagcccaaggtcgcccagacagcaaaaggcagggccagcgctgatttcaagtccaatggcctatggcaatttcttagccaaaagcaaaatctacaaaaataaaaagtcaggcacagtggtgagtgcctacagtcccagctactgaggaggccgacgggggaggaccacttgagcttgggagttcctggctgcagagagctatgattgtgcctgtgaatagccaatgcactccagcctgagcaagatagggagaccctgtctctaaaaaatacctaaataattttaaaagtcagcctctctgactgcctatagagaatgctaactaactgaatgacagaagacctaatgtaatccaggtgcaaaatcagaactttccggccgggcgcggtggctcacacctgtaatcccaacactttgggaggcccaggcgggtggatcacgaggtcaggagttcaagaccggcctgcccaacatggcaaaaccccgtctctactaaaaatacaaaaaattagctgggcatggtggtggccacctataatctcagctactcaggaggctgaggcaggagaattgcttggacccgggaggcagaggttgcagtgagctgagatcgcgccactgcactccagcgtgggggacaaaagcgaaactctgtctcaaaaaaaaaaaaattagaactttccccgtactcttgctagggcttttcatggagatgtagaaatggtagtaagtgccaaggccccagaaccctcatgtttgggtccgactcccacattgccagagactaggcagctcacacaggtgtcccaagctgtctttctcacaggccgcattgaaggcatttatgaaatgagaccccctcttcctcatccgtagtgacagggctggcctgaccgtggagaaatcagatttgatcatgatagcttccactccgtgactggtcacgatctgccaggcgctgtgctaaacactttcataggccttgtccccctccatcctgataacaccccagtgaagcaggccctgctcttcactccactccacaaagccaaggctgagagaggttaacagacttacctaaggtcacacagctaagaagtcgtgaagctgggatcgaatcaagtctgtgtttatgggtttaactatcatgttgtggccccaaccccatttgacctagcctggctggtgggccttcttgcagtagcttcccctggagaagaggaaaagcaaaccttcattgagacccaagcggtctctcctgtgctctgtgacaataataaagttccagcccttg

SEQ ID NO: 78127 - DNA, 1907 bp, Homo sapiens
ggcacccaaccatcgcggttttgctgttggccatcatatgcatggtggatctgccgcccagatcactgggcgtcgtatcacaagtgctgacaaggaaacatatataccgttgagaagcttaagcttcccaacgcgccttgcgacaggggctgcggtattgcatccacatgactgataaactagtaaacacacatgaattcattttaaaagtgtattcaatcagttaggtaaactaaaaaccttaagtcttcgttcgatttggaatgcagccagagaacaaatggaaaatttttcaaggtagagaagatgaaaactcagaacgccctcttgtggcatctctacccaccctaggaacactatggctcttcccctacacatggtgattgctaaccttgctacaagacgttggacacacacacacacacacacacacacactgaggttccttttgccccctcactttgagccagtgactactgaaaccctctccattgttgcaccaccagcaatgcccccatcacttcctctcatttacttccacaggctggttcatcctcaaagccctccttacgtagatctgtgggatcagtgaggctcagagaggtaaagtggccagcccaaggtcgcccagacagcaaaaggcagggccagcgctgatttcaagtccaatggcctatggcaatttcttagccaaaagcaaaatctacaaaaataaaaagtcaggcacagtggtgagtgcctacagtcccagctactgaggaggccgacgggggaggaccacttgagcttgggagttcctggctgcagagagctatgattgtgcctgtgaatagccaatgcactccagcctgagcaagatagggagaccctgtctctaaaaaatacctaaataattttaaaagtcagcctctctgactgcctatagagaatgctaactaactgaatgacagaagacctaatgtaatccaggtgcaaaatcagaactttccggccgggcgcggtggctcacacctgtaatcccaacactttgggaggcccaggcgggtggatcacgaggtcaggagttcaagaccggcctgcccaacatggcaaaaccccgtctctactaaaaatacaaaaaattagctgggcatggtggtggccacctataatctcagctactcaggaggctgaggcaggagaattgcttggacccgggaggcagaggttgcagtgagctgagatcgcgccactgcactccagcgtgggggacaaaagcgaaactctgtctcaaaaaaaaaaaaattagaactttccccgtactcttgctagggcttttcatggagatgtagaaatggtagtaagtgccaaggccccagaaccctcatgtttgggtccgactcccacattgccagagactaggcagctcacacaggtgtcccaagctgtctttctcacaggccgcattgaaggcatttatgaaatgagaccccctcttcctcatccgtagtgacagggctggcctgaccgtggagaaatcagatttgatcatgatagcttccactccgtgactggtcacgatctgccaggcgctgtgctaaacactttcataggccttgtccccctccatcctgataacaccccagtgaagcaggccctgctcttcactccactccacaaagccaaggctgagagaggttaacagacttacctaaggtcacacagctaagaagtcgtgaagctgggatcgaatcaagtctgtgtttatgggtttaactatcatgttgtggccccaaccccatttgacctagcctggctggtgggccttcttgcagtagcttcccctggagaagaggaaaagcaaaccttcattgagacccaagcggtctctcctgtgctctgtgacaataataaagttccagcccttg

SEQ ID NO: 78128 - DNA, 1564 bp, Homo sapiens
gggaatcagaaaccacacacacacacacacacgcacatatatacacacacacgcacacacacacacacacacacacaagtaagagactcagcctgcagttaattagcattctggcagtttgagccagtgactactgaaaccctctccattgttgcaccaccagcaatgcccccatcacttcctctcatttacttccacaggctggttcatcctcaaagccctccttacgtagatctgtgggatcagtgaggctcagagaggtaaagtggccagcccaaggtcgcccagacagcaaaaggcagggccagcgctgatttcaagtccaatggcctatggcaatttcttagccaaaagcaaaatctacaaaaataaaaagtcaggcacagtggtgagtgcctacagtcccagctactgaggaggccgacgggggaggaccacttgagcttgggagttcctggctgcagagagctatgattgtgcctgtgaatagccaatgcactccagcctgagcaagatagggagaccctgtctctaaaaaatacctaaataattttaaaagtcagcctctctgactgcctatagagaatgctaactaactgaatgacagaagacctaatgtaatccaggtgcaaaatcagaactttccggccgggcgcggtggctcacacctgtaatcccaacactttgggaggcccaggcgggtggatcacgaggtcaggagttcaagaccggcctgcccaacatggcaaaaccccgtctctactaaaaatacaaaaaattagctgggcatggtggtggccacctataatctcagctactcaggaggctgaggcaggagaattgcttggacccgggaggcagaggttgcagtgagctgagatcgcgccactgcactccagcgtgggggacaaaagcgaaactctgtctcaaaaaaaaaaaaattagaactttccccgtactcttgctagggcttttcatggagatgtagaaatggtagtaagtgccaaggccccagaaccctcatgtttgggtccgactcccacattgccagagactaggcagctcacacaggtgtcccaagctgtctttctcacaggccgcattgaaggcatttatgaaatgagaccccctcttcctcatccgtagtgacagggctggcctgaccgtggagaaatcagatttgatcatgatagcttccactccgtgactggtcacgatctgccaggcgctgtgctaaacactttcataggccttgtccccctccatcctgataacaccccagtgaagcaggccctgctcttcactccactccacaaagccaaggctgagagaggttaacagacttacctaaggtcacacagctaagaagtcgtgaagctgggatcgaatcaagtctgtgtttatgggtttaactatcatgttgtggccccaaccccatttgacctagcctggctggtgggccttcttgcagtagcttcccctggagaagaggaaaagcaaaccttcattgagacccaagcggtctctcctgtgctctgtgacaataataaagttccagcccttg

SEQ ID NO: 78129 - DNA, 3288 bp, Homo sapiens
aatcctcaacaatgagccctggaaagccactagtactgattcacagctgaaactcattcatcatttgtggatcaaacaattcctaaaaaccctttcagccctgaagataaaaattctggcctttgagtcagggtcttcactctgtacttctaaccttggctccggggtattgccgaaaccagtccaggcacgtcacaaatgtctgacttctcccagaggcttcagaagcacaatgagcagcagaggagagccatggagccaagcacagtctcatttaacctccccaaaagcttgggaagtgggtggtgttatagccccattttacagatgagaaaaactgaggcttatttaagcagctcacctaaagtcacatattgattgtgctgagctgagattgtaccctaatctgccttcaaatccatgtttttacccattgcatgtgattatggaacctgggaccgaggagcaggaggagaacattctaaattctgctcccatcttgtctttacatctcaggtcacttttagcaaagacagacccggacacttgccattaatactacaggcttccttcctcctacccccttcccccaatcttattcatctcacctctccagtaggtcgtggactcatgcattttataattaaagaaggccaaggctcaggggttaagtgacttactggaggttatcagagaggaagttgccaaacccaggctaggaactgaatggttggtttaaatccacccctctggcaggagactggggaatacacatgagccgtgcagacagcagagggcagtcctgggggtgggggcgccagagggtttccggtacttttcagggcaattgaagttccggtcactactcccccccagagcaataagccacatccggcgacgtgtggcaccccaccctggctgctacagatggggctggatgcagaagagaactccagctggtccttagggacacggcggccttggcgctgaaggccactcgctcccaccttgtcctcacggtccagttttcccaggaatcccttagatgctaagatggggattcctggaaatactgttcttgaggtcatggtttcacagctggatttgcctccttcccaccccacagttgccccccaatggggcctcggctggctcacaggatgagggttcaagaagaaggctgtccctggaggtaagagggcttatgaaccatgttccaaacctttgcgttgcttttctttccatcgtgtctatttcataacatccctgtgaggctggatgtgggaacttcagcactgccgtactcttgggaaatttgtccaaggccacccggctgagcagcggttgaaccaggacaccatcaggcatgcgtttcttgtctccaccacaccctcaacccacttcccaacgcgccttgcgacaggggctgcggtattgcatccacatgactgataaactagtaaacacacatgaattcattttaaaagtgtattcaatcagttaggtaaactaaaaaccttaagtcttcgttcgatttggaatgcagccagagaacaaatggaaaatttttcaaggtagagaagatgaaaactcagaacgccctcttgtggcatctctacccaccctaggaacactatggctcttcccctacacatggtgattgctaaccttgctacaagacgttggacacacacacacacacacacacacacactgaggttccttttgccccctcactttgagccagtgactactgaaaccctctccattgttgcaccaccagcaatgcccccatcacttcctctcatttacttccacaggctggttcatcctcaaagccctccttacgtagatctgtgggatcagtgaggctcagagaggtaaagtggccagcccaaggtcgcccagacagcaaaaggcagggccagcgctgatttcaagtccaatggcctatggcaatttcttagccaaaagcaaaatctacaaaaataaaaagtcaggcacagtggtgagtgcctacagtcccagctactgaggaggccgacgggggaggaccacttgagcttgggagttcctggctgcagagagctatgattgtgcctgtgaatagccaatgcactccagcctgagcaagatagggagaccctgtctctaaaaaatacctaaataattttaaaagtcagcctctctgactgcctatagagaatgctaactaactgaatgacagaagacctaatgtaatccaggtgcaaaatcagaactttccggccgggcgcggtggctcacacctgtaatcccaacactttgggaggcccaggcgggtggatcacgaggtcaggagttcaagaccggcctgcccaacatggcaaaaccccgtctctactaaaaatacaaaaaattagctgggcatggtggtggccacctataatctcagctactcaggaggctgaggcaggagaattgcttggacccgggaggcagaggttgcagtgagctgagatcgcgccactgcactccagcgtgggggacaaaagcgaaactctgtctcaaaaaaaaaaaaattagaactttccccgtactcttgctagggcttttcatggagatgtagaaatggtagtaagtgccaaggccccagaaccctcatgtttgggtccgactcccacattgccagagactaggcagctcacacaggtgtcccaagctgtctttctcacaggccgcattgaaggcatttatgaaatgagaccccctcttcctcatccgtagtgacagggctggcctgaccgtggagaaatcagatttgatcatgatagcttccactccgtgactggtcacgatctgccaggcgctgtgctaaacactttcataggccttgtccccctccatcctgataacaccccagtgaagcaggccctgctcttcactccactccacaaagccaaggctgagagaggttaacagacttacctaaggtcacacagctaagaagtcgtgaagctgggatcgaatcaagtctgtgtttatgggtttaactatcatgttgtggccccaaccccatttgacctagcctggctggtgggccttcttgcagtagcttcccctggagaagaggaaaagcaaaccttcattgagacccaagcggtctctcctgtgctctgtgacaataataaagttccagcccttggctcctgtcctgtttctttctgggaatttggggaaggggggaggtggcgaaggcagagaaagaacctgacaggcccagctgaacacccccaagtggctccacac

SEQ ID NO: 78130 - DNA, 1705 bp, Homo sapiens
aatcctcaacaatgagccctggaaagccactagtactgattcacagctgaaactcattcatcatttgtggatcaaacaattcctaaaaaccctttcagccctgaagataaaaattctggcctttgagtcagggtcttcactctgtacttctaaccttggctccggggtattgccgaaaccagtccaggcacgtcacaaatgtctgacttctcccagaggcttcagaagcacaatgagcagcagaggagagccatggagccaagcacagtctcatttaacctccccaaaagcttgggaagtgggtggtgttatagccccattttacagatgagaaaaactgaggcttatttaagcagctcacctaaagtcacatattgattgtgctgagctgagattgtaccctaatctgccttcaaatccatgtttttacccattgcatgtgattatggaacctgggaccgaggagcaggaggagaacattctaaattctgctcccatcttgtctttacatctcaggtcacttttagcaaagacagacccggacacttgccattaatactacaggcttccttcctcctacccccttcccccaatcttattcatctcacctctccagtaggtcgtggactcatgcattttataattaaagaaggccaaggctcaggggttaagtgacttactggaggttatcagagaggaagttgccaaacccaggctaggaactgaatggttggtttaaatccacccctctggcaggagactggggaatacacatgagccgtgcagacagcagagggcagtcctgggggtgggggcgccagagggtttccggtacttttcagggcaattgaagttccggtcactactcccccccagagcaataagccacatccggcgacgtgtggcaccccaccctggctgctacagatggggctggatgcagaagagaactccagctggtccttagggacacggcggccttggcgctgaaggccactcgctcccaccttgtcctcacggtccagttttcccaggaatcccttagatgctaagatggggattcctggaaatactgttcttgaggtcatggtttcacagctggatttgcctccttcccaccccacagttgccccccaatggggcctcggctggctcacaggatgagggttcaagaagaaggctgtccctggaggtaagagggcttatgaaccatgttccaaacctttgcgttgcttttctttccatcgtgtctatttcataacatccctgtgaggctggatgtgggaacttcagcactgccgtactcttgggaaatttgtccaaggccacccggctgagcagcggttgaaccaggacaccatcaggcatgcgtttcttgtctccaccacaccctcaacccacttcccaacgcgccttgcgacaggggctgcggtattgcatccacatgactgataaactagtaaacacacatgaattcattttaaaagtgtattcaatcagttaggtaaactaaaaaccttaagtcttcgttcgatttggaatgcagccagagaacaaatggaaaatttttcaaggtagagaagatgaaaactcagaacgccctcttgtggcatctctacccaccctaggaacactatggctcttcccctacacatggtgattgctaaccttgctacaagacgttgagaagcttgggccgagtcgg

SEQ ID NO: 78131 - DNA, 2207 bp, Homo sapiens
ccactgcactccagcatgggcgacagagcgagactccgtctcaaacagcaacaacaactgaatggctgtaatacattaatgtatacagatgaattgagaagtcttctagtgaaatggctcagatctttgttcttggtccagtcctgttcagtttttgatcagtgccttgaatatcattgatgactcattaaatttataaagagtgcagaggcctcctcagagaatggatgatagaaatgcattgatgagagaagttttatctatctatctgtctatctatctatctatctgtctctatctaagaagtcataaaggctgagtctaataagataaaattttcagtccattcttttggtccaaaaaggcttacattctcaggtatagcttcaacatcatatatgaatattactaagaatcttagtagataagctaaagtcagtatgagtaaccagtctgatatagtttgcaagaacactcttcatggactgcaccaaaaaaacctatggtagcaagagacagtttttattagaagtactgtctgttataccacatatggagtcttaaattagttttgggtgtcattttgaggcctagagtcatagaagagtgattaggagcttgtggggtataaaaataacttgagaattggctgaaagcaactagggaagatgggggtagtagtatgtgtaaacatttgaggcagtagagatgtgggacccaaatactgttccccttttactcaaattctgagatgagttgacatgttctgtgtagggctagagagtagaaaaatggccagtaggtggtagccacagagaagcagtgcgtacaaacaagtaagtatgcaaaatttgtacatacggtttcaggaataactagaatacccataaaatatccacctgccttaaaaactagaacatcattgataacttggaagcccttgcatacctctccatgatctcatttgtcttcacagctatataaatctcattgtatgattataccataatttattcatcctgttgttaaaggatatttgggtttccagtttttctttttttactaccaaagcactacattattaatattcttgtatatgtcctgatatgtaagtgcaaaagtttcttttacagcaatggctcttgaagagtggttcccagaccagcagcatcagcatcccttggaacttctttgaaatgcaaattctcaagccccctacccagacttactgaattcaaaactatgtgggaggagcccagcaatctgtgtttcgcaaaccctccaggtgattctgatgcacagtaaaatttgagaaccactgtttaagagtattgacatagaatggaattgctggatcatagagtatatacatgttcaacttttttgagaagcactaaacatttccaaagtgcttatattagtttatgtctctactatcaatagatgagtcaccccaatgctccccatcctcttctgtgcttggtattatcttttaggtattgcaaatacaggagatttgagtattatttccttgtggccttaatttgcatttctgattattaatgagcttgagcatcttttcatatatttagaagccactaatattttctctcggtaaaatgcctattcgagtctttgcacactgctgtattggatgtcaaattgatttatatattccctgtactaatcgtttgtctacatacagttttatcctgtttttttttttattctattgggtcttttgctgaacagaagttcttaatttcaatgtcattgaatttatccatcttttatgataatgctttttgtgttttaagaggttcttagctctcctaaagtcataaggacattttccctctactgctttatgaagttattttgtccttttcttacagtatgactttattttatgttatgtacggatataatttttttcataatgagtaaatagcccagcaccttttattaaagaatcaatcctttccctactgatctttaaaaccaacagcaagagcccacgacgcgaaacaacacgctcgcgccccccgcgcccgcgagaacgggtgccaaaaccacagtctggggcgcgggggcaatagcgcgagcaaccgccaacgggcaccaaaaaacacggacacaacagggggggcgttgccacaaaaaaaccgcgcggaacggcgcttggaaaaccaagaggcgcggccacg

SEQ ID NO: 78132 - DNA, 1608 bp, Homo sapiens
ccactgcactccagcatgggcgacagagcgagactccgtctcaaacagcaacaacaactgaatggctgtaatacattaatgtatacagatgaattgagaagtcttctagtgaaatggctcagatctttgttcttggtccagtcctgttcagtttttgatcagtgccttgaatatcattgatgactcattaaatttataaagagtgcagaggcctcctcagagaatggatgatagaaatgcattgatgagagaagttttatctatctatctgtctatctatctatctatctgtctctatctaagaagtcataaaggctgagtctaataagataaaattttcagtccattcttttggtccaaaaaggcttacattctcaggtatagcttcaacatcatatatgaatattactaagaatcttagtagataagctaaagtcagtatgagtaaccagtctgatatagtttgcaagaacactcttcatggactgcaccaaaaaaacctatggtagcaagagacagtttttattagaagtactgtctgttataccacatatggagtcttaaattagttttgggtgtcattttgaggcctagagtcatagaagagtgattaggagcttgtggggtataaaaataacttgagaattggctgaaagcaactagggaagatgggggtagtagtatgtgtaaacatttgaggcagtagagatgtgggacccaaatactgttccccttttactcaaattctgagatgagttgacatgttctgtgtagggctagagagtagaaaaatggccagtaggtggtagccacagagaagcagtgcgtacaaacaagtaagtatgcaaaatttgtacatacggtttcaggaataactagaatacccataaaatatccacctgccttaaaaactagaacatcattgataacttggaagcccttgcatacctctccatgatctcatttgtcttcacagctatataaatctcattgtatgattataccataatttattcatcctgttgttaaaggatatttgggtttccagtttttctttttttactaccaaagcactacattattaatattcttgtatatgtcctgatatgtaagtgcaaaagtttcttttacagcaatggctcttgaagagtggttcccagaccagcagcatcagcatcccttggaacttctttgaaatgcaaattctcaagccccctacccagacttactgaattcaaaactatgtgggaggagcccagcaatctgtgtttcgcaaaccctccagaatgtcataaaattggaatcagagtatgtaccttttcaggttgactccttactccatggattacctttcaaaatggacatttaaaaataattttagaatgatactaaagctacaatagagggtaagtgtatttctagataatcaccagtgatgagaagttttctttgcaatgtacatggtagcaagtggtagaaggatctgatccagtgtacaacatttcatttagatgtcatgtctctccatccgagtctgtgaaagtttctgtcttttcttgttttttttatgaccttgacagtccagaggagtattgtgtagaatgatcc

SEQ ID NO: 78133 - DNA, 2249 bp, Homo sapiens
ccactgcactccagcatgggcgacagagcgagactccgtctcaaacagcaacaacaactgaatggctgtaatacattaatgtatacagatgaattgagaagtcttctagtgaaatggctcagatctttgttcttggtccagtcctgttcagtttttgatcagtgccttgaatatcattgatgactcattaaatttataaagagtgcagaggcctcctcagagaatggatgatagaaatgcattgatgagagaagttttatctatctatctgtctatctatctatctatctgtctctatctaagaagtcataaaggctgagtctaataagataaaattttcagtccattcttttggtccaaaaaggcttacattctcaggtatagcttcaacatcatatatgaatattactaagaatcttagtagataagctaaagtcagtatgagtaaccagtctgatatagtttgcaagaacactcttcatggactgcaccaaaaaaacctatggtagcaagagacagtttttattagaagtactgtctgttataccacatatggagtcttaaattagttttgggtgtcattttgaggcctagagtcatagaagagtgattaggagcttgtggggtataaaaataacttgagaattggctgaaagcaactagggaagatgggggtagtagtatgtgtaaacatttgaggcagtagagatgtgggacccaaatactgttccccttttactcaaattctgagatgagttgacatgttctgtgtagggctagagagtagaaaaatggccagtaggtggtagccacagagaagcagtgcgtacaaacaagtaagtatgcaaaatttgtacatacggtttcaggaataactagaatacccataaaatatccacctgccttaaaaactagaacatcattgataacttggaagcccttgcatacctctccatgatctcatttgtcttcacagctatataaatctcattgtatgattataccataatttattcatcctgttgttaaaggatatttgggtttccagtttttctttttttactaccaaagcactacattattaatattcttgtatatgtcctgatatgtaagtgcaaaagtttcttttacagcaatggctcttgaagagtggttcccagaccagcagcatcagcatcccttggaacttctttgaaatgcaaattctcaagccccctacccagacttactgaattcaaaactatgtgggaggagcccagcaatctgtgtttcgcaaaccctccaggtgattctgatgcacagtaaaatttgagaaccactgtttaagagtattgacatagaatggaattgctggatcatagagtatatacatgttcaacttttttgagaagcactaaacatttccaaagtgcttatattagtttatgtctctactatcaatagatgagtcaccccaatgctccccatcctcttctgtgcttggtattatcttttaggtattgcaaatacaggagatttgagtattatttccttgtggccttaatttgcatttctgattattaatgagcttgagcatcttttcatatatttagaagccactaatattttctctcggtaaaatgcctattcgagtctttgcacactgctgtattggatgtcaaattgatttatatattccctgtactaatcgtttgtctacatacagttttatcctgtttttttttttattctattgggtcttttgctgaacagaagttcttaatttcaatgtcattgaatttatccatcttttatgataatgctttttgtgttttaagaggttcttagctctcctaaagtcataaggacattttccctctactgctttatgaagttattttgtccttttcttacagtatgactttattttatgttatgtacggatataatttttttcataatgagtaaatagcccagcaccttttattaaagaatcaatcctttccctactgatctttaaagcccagtctgtctttttctttttttgaaattgtctagctttttaatttttaccaaccagatgattataaaatatcacatagtaggcataaattacatttctttgtccattcctgtttctttttctatgaaatctctgttttcttttgtccaatttttattgggttgtcttcttattgattccttacatgttctggatactaatccattataaattatgtttttcaaatatatttatccaaatcgcaaat

SEQ ID NO: 78134 - DNA, 2191 bp, Homo sapiens
ccactgcactccagcatgggcgacagagcgagactccgtctcaaacagcaacaacaactgaatggctgtaatacattaatgtatacagatgaattgagaagtcttctagtgaaatggctcagatctttgttcttggtccagtcctgttcagtttttgatcagtgccttgaatatcattgatgactcattaaatttataaagagtgcagaggcctcctcagagaatggatgatagaaatgcattgatgagagaagttttatctatctatctgtctatctatctatctatctgtctctatctaagaagtcataaaggctgagtctaataagataaaattttcagtccattcttttggtccaaaaaggcttacattctcaggtatagcttcaacatcatatatgaatattactaagaatcttagtagataagctaaagtcagtatgagtaaccagtctgatatagtttgcaagaacactcttcatggactgcaccaaaaaaacctatggtagcaagagacagtttttattagaagtactgtctgttataccacatatggagtcttaaattagttttgggtgtcattttgaggcctagagtcatagaagagtgattaggagcttgtggggtataaaaataacttgagaattggctgaaagcaactagggaagatgggggtagtagtatgtgtaaacatttgaggcagtagagatgtgggacccaaatactgttccccttttactcaaattctgagatgagttgacatgttctgtgtagggctagagagtagaaaaatggccagtaggtggtagccacagagaagcagtgcgtacaaacaagtaagtatgcaaaatttgtacatacggtttcaggaataactagaatacccataaaatatccacctgccttaaaaactagaacatcattgataacttggaagcccttgcatacctctccatgatctcatttgtcttcacagctatataaatctcattgtatgattataccataatttattcatcctgttgttaaaggatatttgggtttccagtttttctttttttactaccaaagcactacattattaatattcttgtatatgtcctgatatgtaagtgcaaaagtttcttttacagcaatggctcttgaagagtggttcccagaccagcagcatcagcatcccttggaacttctttgaaatgcaaattctcaagccccctacccagacttactgaattcaaaactatgtgggaggagcccagcaatctgtgtttcgcaaaccctccaggtgattctgatgcacagtaaaatttgagaaccactgtttaagagtattgacatagaatggaattgctggatcatagagtatatacatgttcaacttttttgagaagcactaaacatttccaaagtgcttatattagtttatgtctctactatcaatagatgagtcaccccaatgctccccatcctcttctgtgcttggtattatcttttaggtattgcaaatacaggagatttgagtattatttccttgtggccttaatttgcatttctgattattaatgagcttgagcatcttttcatatatttagaagccactaatattttctctcggtaaaatgcctattcgagtctttgcacactgctgtattggatgtcaaattgtttattctattgggtcttttgctgaacagaagttcttaatttcaatgtcattgaatttatccatcttttatgataatgctttttgtgttttaagaggttcttagctctcctaaagtcataaggacattttccctctactgctttatgaagttattttgtccttttcttacagtatgactttattttatgttatgtacggatataatttttttcataatgagtaaatagcccagcaccttttattaaagaatcaatcctttccctactgatctttaaagcccagtctgtctttttctttttttgaaattgtctagctttttaatttttaccaaccagatgattataaaatatcacatagtaggcataaattacatttctttgtccattcctgtttctttttctatgaaatctctgttttcttttgtccaatttttattgggttgtcttcttattgattccttacatgttctggatactaatccattataaattatgtttttcaaatatatttatccaaatcgcaaat

SEQ ID NO: 78135 - DNA, 233 bp, Homo sapiens
gaaattgggaaagaaaaatattggggctgtctggggttgcctaccattcacttaccctgcagaggacagaaaccaaccactaactgcttttatatccaaatgtgtattatcttggagtacattatttggggtttactgaatatatgccaaattcctttctgtaattttagaataatcatccattcaattatggctattgtaataaaactccttaacatttaataaatgcaaag

SEQ ID NO: 78136 - DNA, 327 bp, Homo sapiens
tgataaccatttttctactctctatgtccatcatacattctgattttaaaacggttttcctacatttcatacataagtcactcaagtacacagaattatttttatgggataataaaatgcttaaaataatttaatttttgtctttgacaatgaacgtacctgaaaattgtggctttcactgttatcattgacgacaccagtgaagttacaaagctgctcattagtaactgaaattagattttctcttgttgaaggaattttcagtttttcagagaatgagagttgtaatctctaatgcaaaaataaaattgaactttgaaaagatct

SEQ ID NO: 78137 - DNA, 920 bp, Homo sapiens
aaactgcaccgccatcttagatcttgcagccaaattcctctgaacttttctctaaagacgtgctctggaaaaatgttgatcattttcctacatcatggaggtcttttcatgaccacctttgtctagacaatgtcctgtttttaggtgcacgtttgagggctggagtctctgacccacagtgctgcagcctgcacgtggtttgtcctgacttctttgctacttcacttttcgtaaggctctgagagtgcaggcccttgtgggtggacactgcagggtgagaggaagaagtaaactacttttttccgtttctgatgggggtgtgggtcagcagctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtggtgaggactcttggtccttggatgacaacactcccctgcccacttctccagccttccctgtaaccctttgccacctctaaccaatcttctgtgttacatctcttcggtttgcaatatgtagtgttcgtatatgactggacagtatctactggagttaatatctatcagagtaattatatcacaattgcaatcttctcctaagagtgaatagtgacattaaaaatttcaacattataaattatgcagaaataaaactaattatacaaaaaatacactctgaatgtcagtttttccctgagacaatctaccatttgatatacggtgattcacacttcttaatatacaacattgaattacttttccaaaagcctcttcaaattttgctgcagaattaaacttcacttgcacc

SEQ ID NO: 78138 - DNA, 687 bp, Homo sapiens
actccaaagcccccacatgttccacagcccctgtgatttctacgcaccaagtgttatagaaaggtactccttcaactgtgatgggattagagttaaaaatgaaaatttactccagccttggcaacagagcaagatcctgtctctgaaataaataaataaattgaagattttaaaatgtaaatttttttctttcttttttttttttttttttgagacggagtctcgctttgtcgcccaggctggaatgcagtggtgcgatcttggctcactgcaacctccacctcccaggttcaagcgattctcctgcctcagtctctcaagtagctgggattacaggtgcctgccaccacgcccagctaatttttttgtattcttagtagagacggggtttcaccgtattagccaggatggtctcaatctcctgacctcttgatccacccgcctcgggctcccaaagtgctgggattacaggggtgagccacggcgcccggccatgttttgttttgttttgttttgagacagagtttcgctcttgttgcccagactggagtgcaatggcacgatcttggctcaccacaacctccacctcctaagttcaagagagtctcctgcctcaccctcccgagtagctgggattacaggcatgcgccaccacgcctggctaattttgtatttttagtagagatg

SEQ ID NO: 78139 - DNA, 1085 bp, Homo sapiens
agaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtatttt

SEQ ID NO: 78140 - DNA, 781 bp, Homo sapiens
atctccacaggcttggcgacgccatgtttcaagggcagcgcggttggttttgcggcagcgttagccaggatctgaggcaattctgggtggctgaagggggaacgatcagtgacccgcgagccgccgacttcttgttcagctgtgatgcctcgcacccagacacgctgagaatatatcagagccttgattacatagaagataatgctacagtttttcatgcctactatctctctgcggtagctaatgccaaaataaaaaactcggtggctttgggtcatttcattcttcctcctgcgtgcctgcaaaaagaaataagaagaaaaattggtagttttatttgggaacaagaccaacattttctgatagaaaagcatgatgaagtaacaccaaatgaaataaagacccttagggaaaacagtgaactagcaacagagcacaaaaaagaattatccaaaagcccagaaaagcattttataagaactccagttgtagaaaagcagatgtacttccctctacagaattacccagttaacaacatggtaacaggttatatatcaattgatgccatgaagaaattccttggggagctacatgacttcattcctggaacctcaggatatttggcatatcatgttcaaaatgaaattaatatgtctgctataaaaaacaaattgaagaggaaatagtaaattaaattgtaaataccttggcatttattttctataaaatattatacagatgtgcatatcataaaatgctcccttttggtactgggggatag

SEQ ID NO: 78141 - DNA, 967 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 78142 - DNA, 1002 bp, Homo sapiens
  misc_feature (112)..(112): n is a, c, g, or t
  misc_feature (186)..(186): n is a, c, g, or t
  misc_feature (216)..(216): n is a, c, g, or t
agcattggttaggagagcggaccgcagaaagtaagtgaatatggtcgatagctgtatcctgaggtagacatgcctgtgcgtcgatgaatctagatgccttgaggatccatcnacactatgtaacaaagaccgccctggtgtgtggaactcgtagtggttccttgaaacagaaatcccatgataggnaccgttctggagcgatcaatagaactgtcnatctgagtcaagcgatggtagtgccaatatgtcgcagagtagaatactgataattagcagtccactcgtcacagttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 78143 - DNA, 755 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagctcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 78144 - DNA, 1477 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacctgcatttgtttagtgcttgtcatagtcccatatctttatcttatgtctactacttatctatctactaattggtgtttcattggtaattggtgtttcattatcctgaaaactccaattgccaagtacggggaggaaaacctgtaagtaactagaaagatatatcgcaaagccagagcactcaatgagcacaacagtggcaatacttaaaagctactaacaatcattttaatgacgattcaaaatatgtgtggaattgtaatcacaattctcctatttgtttttccagctacaaatcgatcaaaaaggggtctgaggttgcatcagggagacaactgtaatgatataagtaagcaatagttgagaacctgacagcaagtaataagacaggaagaataaaactagaagaagtcagaatgaaaaccaaaaaagtatgagactgggatcattttgtatgaagacaaacataactttatgtctcaaaaacctcagtaggactgtacaatgcttgattttcataatgttctcttgatgtcatcaaaaaatattatactctgaatattgctcacatga

SEQ ID NO: 78145 - DNA, 640 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctcttcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacct

SEQ ID NO: 78146 - DNA, 1536 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttggtgaaaaagggtctgcgacagggttactttgtggaagctcagcccaagattgtcctggggcaggaacaggattcctatgggggcaagtttgataggagccagtcctttgtgggagagattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacctgcatttgtttagtgcttgtcatagtcccatatctttatcttatgtctactacttatctatctactaattggtgtttcattggtaattggtgtttcattatcctgaaaactccaattgccaagtacggggaggaaaacctgtaagtaactagaaagatatatcgcaaagccagagcactcaatgagcacaacagtggcaatacttaaaagctactaacaatcattttaatgacgattcaaaatatgtgtggaattgtaatcacaattctcctatttgtttttccagctacaaatcgatcaaaaaggggtctgaggttgcatcagggagacaactgtaatgatataagtaagcaatagttgagaacctgacagcaagtaataagacaggaagaataaaactagaagaagtcagaatgaaaaccaaaaaagtatgagactgggatcattttgtatgaagacaaacataactttatgtctcaaaaacctcagtaggactgtacaatgcttgattttcataatgttctcttgatgtcatcaaaaaatattatactctgaatattgctcacatga

SEQ ID NO: 78147 - DNA, 1418 bp, Homo sapiens
aagactggtatcaacgcagagtgcccattacggccgggagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctttgctcacacagacctcagtgggaaggtgtttgtatttcctagagaatctgttactgatcatgtaaacttgatcacaccgctggagaagcctctacagaactttaccttgtgttttcgagcctatagtgatctctctcgtgcctacagcctcttctcctacaatacccaaggcagggataatgagctactagtttataaagaaagagttggagagtatagtctatacattggaagacacaaagttacatccaaagttatcgaaaagttcccggctccagtgcacatctgtgtgagctgggagtcctcatcaggtattgctgaattttggatcaatgggacacctttattggggatttgtacatgtgggactctgtgctgcccccagaaaatatcctgtctgcctatcagggtacccctctccctgccaatatcctggactggcaggctctgaactatgaaatcagaggatatgtcatcatcaaacccttggtgtgggtctgaggtcttgactcaacgagagcacttgaaaatgaaatgactgtctaagagatctggtcaaagcaactggatactagatcttacatctgcagctctttcttctttgaatttcctatctgtatgtctgcctaattaaaaaaatatatattgtattatgctacctgcatttgtttagtgcttgtcatagtcccatatctttatcttatgtctactacttatctatctactaattggtgtttcattggtaattggtgtttcattatcctgaaaactccaattgccaagtacggggaggaaaacctgtaagtaactagaaagatatatcgcaaagccagagcactcaatgagcacaacagtggcaatacttaaaagctactaacaatcattttaatgacgattcaaaatatgtgtggaattgtaatcacaattctcctatttgtttttccagctacaaatcgatcaaaaaggggtctgaggttgcatcagggagacaactgtaatgatataagtaagcaatagttgagaacctgacagcaagtaataagacaggaagaataaaactagaagaagtcagaatgaaaaccaaaaaagtatgagactgggatcattttgtatgaagacaaacataactttatgtctcaaaaacctcagtaggactgtacaatgcttgattttcataatgttctcttgatgtcatcaaaaaatattatactctgaatattgctcacatga

SEQ ID NO: 78148 - DNA, 706 bp, Homo sapiens
aggcaattggtcaaccttattgtcctgctgccagcacagtgggagtaggtggtagcgctggagatgaggggagatggaaaaggtgagacttggaaggacaatcctggggtacggagggaaaacaaactgctctgattcctgaagcccaaacaaacataactttccatcttctaacaactagaaagcagaagtctcctgagagttcaactctgatttgatatcagtctctcttatgcctaatcagctgtcctgattatgtgactcaggactctgagaaatatcctcaggaaaacctaaatatgttcatgagaaataacatttaagcatgacagtgtgcagaagaactagacaggtcacaatggaatgtgatgaggcaaaagagaaaaagaagtagatagacctgcctatgcctttcttagaagatgccaggaaggtggtcagattctttcctctgtcagaaaagtagctgtatgtgtcaaagtttacagattatccatccactctctctttactagggatttaacttttactatctgtaccattcctgtactctgacattacctggttatgtctgatatacatattttacttttcacgtgcttctggtcttacctagctaaactgtaaactctttgagagatgcaggacaatgtgatttgtctttggttttaaactccggccagacttgctttttttaaaaaaaaaa

SEQ ID NO: 78149 - DNA, 109 bp, Homo sapiens
gtggttggctctttcccgtagtctcaacatttcatttactttatatttacccttattcttactttatactatttcttaagactttactcggcaccacctattagccaac

SEQ ID NO: 78150 - DNA, 435 bp, Homo sapiens
ccaccccacctgatattggcattcactgaatgttgttggcaaacacagaataccatgctttaggtactaggaatacgaagaataagacaagaactttgcccaggagagttcagtctaaataggggaataatcaatcatgtctacacactaagaaacgattctacagttgaactctgactgcctgtatgcctcatgcatgcttcctagagaagccatttctgctgggtccccaagtatgaataaagaatttaggaggtaggggatggggtgagaagagattctctgtataagcaaaggcactgaacaaagaccggagaacatgattctaggaaggaccaactacaagcgttacaactacagcagcattccccaggagatactaattactaatatgtattatagtaataaagacagtaatatttttcttctaaattt

SEQ ID NO: 78151 - DNA, 378 bp, Homo sapiens
cccttacttttttttggtagctcatagcacaaggttaaatcccttaaattctggttattagattaaatctttatatgatcatacaagccctgagaggtagacctctactagctttgaatgggccaagtaagattctacccccaattatttgtactttattgacattcatagcaatcctgtgagataggcaagtcaggttatttgacagacgagaaaaagtgagccaaaaaaagaattaagtgggtcaggcatggtggcttatgcctgtaatcatagcactttgggaggctgaagtggaaggattgcttgaggctaggagttcaagaccaacctggccaacatagtgagctcccatctctattgtaaatatttaatact

SEQ ID NO: 78152 - DNA, 869 bp, Homo sapiens
gggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgt

SEQ ID NO: 78153 - DNA, 848 bp, Homo sapiens
  misc_feature (741)..(741): n is a, c, g, or t
  misc_feature (743)..(743): n is a, c, g, or t
gggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacccggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttagtatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctccttataggctttgcccttcaaaacgttngnctcaatttttttaacttttttttgtccttttttgggattttttttaaacaccttttttaaaagggttttttaaaatttttaaaattaaaccggcaatttcgtttt

SEQ ID NO: 78154 - DNA, 532 bp, Homo sapiens
gtctacctcagccttcccaaatgctgggattacaggcatgagccactgcacctggcaagaaatcccctcttattattaaaattaatgaggagaaattaaaatccaaaaattgattactcttgccaattaaagttcaaaatcaaataacttaccaatgtgagttaaaggttaaggaatctaaagtccagaaatcatccaaatttatttttcttgtctatctcagcaggagaattttttaaacagctgtgtcctaggccaatgctgctcagactttagtgggcataaaaatcacctggagggcagtcggccagctctcggggtgctgagccaggcgggctaggcgaggcgcgggctggccccgcccctctggccggccccgcccctcaaggccggctagtccccttcccagagacttggctaggcgccggcgctgcggcgccagcagccctgtggtggcgacgacgatggaccaggacccagtgggccctgtggaacgaggagaagccgtcgcagcctcgggagctgcggccgc

SEQ ID NO: 78155 - DNA, 454 bp, Homo sapiens
atgagaacagacaatacaatatatttgtactgtttttaagctactgaaactttggcaatttgttacagcagcaatgggaagctaatacagatcccttttagcaataacttctgttgaagctatgaacatataatgtttgaagggtcactagaaaattctaaaatcagatagtgatatgcaaaaaaagatgactactaaccatgatttgagtgtgaaatgtagggcttactgaagataaagtttgtaaaagcagaaaccagtaagaagggaaaataagacaccagaatccatgaaggaaaaaaggatagaaaaaacactgtgaaggaagaagcatactttagcattttcttatgcttgaagtatgtgaaacagctgtatacatttttttctctttccttgattggcagaatggagaatgttaacagatacttgtttagaaggaacagaagcttag

SEQ ID NO: 78156 - DNA, 792 bp, Homo sapiens
aggaaattattacaagattgttaactagaatatagacctaatttccaccattttacatgcatttttatgtgtgtgtgtttttctgtgtggtcttatcccatgtatagatttgtttaacaaccaccacagtcatgatataaaactgttcaataggacctcccttgtgcttccccttcataatcatacccaccctgccccatccttgctccctggcaatgattaatctgttctgtatctctaaaattttctaatttcgagaatgttacataaatagagtcctatacaatgtagtcttttgggattgacgttcttcaccaaatgtaatccttttgagtcatatctgggttgttgtgtgtatcagtaatttgttccaactgagtagtattcccttgggtggatagaccagaatttctttatccaattactagttgaaggacatttgggttgtttcctcgttttgcaattacagataaagttgctgtgaacatcagcatgcaggtttttgtgtgactataagttttcatttctctgggataaatgcccaggaatgcacttgcagggtcatatgataagtacatgtttagtctcataggaaattgccagaatgatttccagagccttaccattttatattcctaacatcattgtatgagagatccattttttctacatccttgtgaacatttggtattactgttttttattttagccattcttataggtgtacaatgatagcttagcttattgtggttttaatttgcatttccttagtgactaatgatgttgaacatg

SEQ ID NO: 78157 - DNA, 577 bp, Homo sapiens
aaggggtggaaaaatatttcatgtgcaaatggagactaaaagcgagcaggaatagccattcttttatcagacaaaacagactttagagcaacagcacttaaaaaagacaaagagggacattatataatgatgaaaaagccttgtccaacgggaaaatatcataatcctaaatgtatatgcacctaacactgaagctctgaaatttataaaacaattactactagacctaagaaatgatatagacggcaacacagtaatagcgggggactttgatactccactgacagcactagacaggtcctcaagacagaaagtcaacaaagaaggaatgaacttaaactataccctacaacaaatggacttaacaggtatttacagagcattctacccaacaactgcagaatatacattctattcatcagcacatggaacattctctaagatggaccatatgataggccacaaaacaagtctcaggaaatttaaaaaaatctaaatttggagcttgcagtgagccgagatccggccactgcactccagcctgggcgacagagccgaactccgtctcaaaaaaaaa

SEQ ID NO: 78158 - DNA, 428 bp, Homo sapiens
ctcagtccctttcagtgctgctgggccttaaccaaagtattctcctgaaatatttttccctttaatgtctggaaaataacatgtattttttttttaaaggctgcctcctctgagaagccttccagggtcaccttaggtaaaactgattgtcagtctctctttttgccagccttacctatgccctgtatgtgctactgacatcacaagtcacttcatatttcatctattttaaaatgcacttttattcacattttttaaaaatccctgaaatcagccagatgtggtggtacaggtttgtagttgcagctactgaggaggctgaggcaggaggatcacttgagcccagggctcgaggctgtagtgttatgatcgcacctgtgaatggctaccacactgcagccttggcaacacaggcagaccttgtctca

SEQ ID NO: 78159 - DNA, 424 bp, Homo sapiens
gttcctattaaatttgaaaaatgttacatgtatacatatggctatacatttcttaaatattgattaatttgtattgccattatacttttaagattgcaggctatgtaaaaatgccagtttatttcacataaatgtgtggtcaaggtaaaattggatagaatcacagaaaaattgatttcatgaactatttttaaaaaactaaagacatgcaagtttctcaataaggttttgggaaaatacacgctttccaggattttctttaatcttttgggaagtaaatgctagctaataggtagatcttaggtgattccaaaaacattccaagttaaaatgttggaaaaaagtctttctgggtccattctctgctcaaactaaataatctcagagcacatgaattgttttgaaaatgtgaataaagggcaaa

SEQ ID NO: 78160 - DNA, 765 bp, Homo sapiens
acactggttagttaacagagctagtgctgaagtgaaatctgccttaccctggtatattattttcattacaccataattctctattttaagacttattacattcaaaaatcaacatgaaaataaatattacaataaaccactgacagtttccaaatagctagatgtttggcatttagtcattaaaattgatatttttctgcttttcagttgtagtataactatttgatattttatatgttgctttagcagtcatttggctaacaatggaagaaaatacggcctgtaagcatgttttacaagtgaaataaagtgccctgaaaaattgaattagaaatttagaacatttcttgttctaaaggtgttcaccactgtttctccttggactgactagactggccatttgaataagcatagaaagaatgatgaagatttaaaaattaccattttgcaatctccagagtaaaaagtgactcaaataagaatgatcaatggatgttaaatctgaggaggaaggcagtatgggaataaggtatttacatagcatcaaaatgtcatccataaattacaaaagaaaaaaaggaacttttcaatggctaaattggataacaccttaactaagtcatcaaaatcaacatcaccaataatggacagatggagcatgtgcctctggacatgatgctctgaaaaagagacagcgtcactcaggtaataatcatgccaaaaatgcacaacctgagtctaattatgagaaaacagacaaaccca

SEQ ID NO: 78161 - DNA, 460 bp, Homo sapiens
cagcctacaactccagggctcaagcatttctcctgtcttagcctcctaagtagctatacttaggactacaggcttgtgcagccacgcccagctatttttttttttgtaaaggaggggtctcactatgttgcccaggctggacttggcccaaagttttgggattactggtacctggccttcaataatttttcagagtgaaaaagaggggtcctgcaatcgaaaagtttgtgaactactcttctagataggtcattggccctcaaccctagaattagaattacttcaaacactagaattacctggagaatttaaatactgatgccaggcctcacttctagacgttctgatttaatgtgcagggcctaatcccaagcatcaatttgaaaaacaaaacaaaacacccctcatccccttgaatgtgcagtctggattgagaaccactgctctggatattatcaat

SEQ ID NO: 78162 - DNA, 346 bp, Homo sapiens
gggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggtaagaaagggcaattttgctatttatattttctcctgtgttccagttatagctggccagaaacattcctaatctgttccattgctgcactttaataggctgagaatat

SEQ ID NO: 78163 - DNA, 948 bp, Homo sapiens
gaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatg

SEQ ID NO: 78164 - DNA, 181 bp, Homo sapiens
tagtataaatggaacaggagcaaattcttcacctccacagtaacacaaagtacagaggacgggccacgagctagctgacgagaggaagtgggtctgaagacctgagcttccaccaaagggcaaacaattcagaacaactcaggaaacccaggccctgtgttgcctgaacttccccattctg

SEQ ID NO: 78165 - DNA, 534 bp, Homo sapiens
cctgcttgttcctacagggagcaggattgttgggccccaggcatgcgtgcacggggttggcccaacactgagtggcttccagctgtcatcttaagcgttctttttcctcctcagtcctcctggcaggagtcggtgcttcttgctgcgttctttgtgaggatttactgggacctttttaaagtcccgtgggggcccaggaggctctgaacaagctccggggtgtgcttggggtgggtggagggtgtttctggtttctagtttgggaagcgccttcccctagcataagctgcacatgtgagggagatggtgttggccccaaggagtcagatgactccagtgggagaggaggggagggcagagtggagtcaggattggcatgaatcgtgcctcaggcccagccatggcccttctgcaacagagtccacgaatgccagcaccgtgagcacatgcgacaggcaccctggtgcatttaaatcataaattagcccatcataatcgcagagcatgcacctcacaccagcaaggacttcctct

SEQ ID NO: 78166 - DNA, 851 bp, Homo sapiens
ccttgggggataacaggagaggatacatttcagcttccttaggacaattgtaacaggcagtgggtctgttcagtcaggctgcaggggaacagggtaacctttgaaatgtaagtggccttcagaatggggctcaagcagtggttcacggttggggcctatgtgttccaattcagtggacatgtatgtagtcttttcatttatctctgatgtcagcaggcatgagcaggtgataaaatgaaaaattatttgaataaatgttgacaagagttctgtggtggtttgggccatgacaattaccaacacttgggtgggcatggttaaaaggctaaagaggatctgtattgaagtaaatggttgggtttatttttgccctagcctttcactttttaaaacctgcccattttacaaaacaaagcttaaaacccaggtatctgctatctaatagaaatgtgtaaatgaccaacctaggcaatgtggtgaaaccctgtccctacaaataaaatttaaaaattaactgggcatggtggtacgcatctctgtagtcccagctgccaggaggctgaggtgggaggattgcttgagccccggaggaggaggttgtagtgagctgagattgtgccactgcgttccagcctaggagacagaccctgtctcaaaaaaagtataaatgagtttagtctgcctggtgggtggtgtggggaaggaagttggcctagtctgttaatgttcctgaaaggagtgaagggtgggctgaactaaaccaaaaggtgaaagaaagatgttttaacaatttatattaaatgaaaactatggtatagtttttatttactttgctaggataaaaggaaaaa

SEQ ID NO: 78167 - DNA, 644 bp, Homo sapiens
agtgataagaaaatggagaatactgtatttgctttagaaagtttttacatatagataaacacgcagtttaagataacagtaaaagcgccctacagggagtgagagatacctctgaagctgctaagaaatactggaaatagcttttgcataagaatactacaatctcactctccgcttttgctagcgacagggtccctcttcctaacccaggccaccatgcctctccttgactgccaagtcgacaccaggagcaccgagtgggaggagaaccccaaaaagaaaagagacagttgagcggggagaaagacagagagagggagaggagagaaagagaaagggagaggagaaaaagcaatatcatatacaggcaatttctacacatatattacaaactgggaaaatgaccgatcattaagatatacataattcatataaaattttgaaataaaaataaaaatctgttacagtcataactattctttttccacatttataaccagtacccacacaggcagtgacagagtggagagaaaaaggtgcttacgaagaaaatgattgtctgctgaacaaaaaacagaagattgcatttttttgaccaatacttgacttaaaaacagagagaagaagagaaagaaagagagcga

SEQ ID NO: 78168 - DNA, 311 bp, Homo sapiens
tgggaattaataggccactgtctgaaggggtttgattcttgaagaatcacagggcatcattcaagagctttggtactatttgctatgacttattcaaaaatcctactaaggaggaaggtggtttgctctattataatttccaagtgaatcatgcctcagtactgtgttgcctttgtgaccaggcaagctttgagttttacattctgagtggcttgctccaggctctaagcagcccccttctataagacgtttttttgtttttgttttttgtttgtttgtttttgtctaaaggagacaccaaaggctgggag

SEQ ID NO: 78169 - DNA, 647 bp, Homo sapiens
gaactccagctttgaacttactactcactatttgtgtaaacttaggcttaaggtaactcctggaagcctcagtttccttttcttaaataatgtcctcctcttagttttattgagagaattaaatgatacatatagggcccttttcatgatgcctggcacataataaatggtagttactattattatgaattaattagtattactgttagatacggagaaatcaaagcccttccagggcaactgacccacgcaaacctgaactttttgaatggggaaaattcttgcattcattccccttcaacaaaaccccatttcagacctgaccaaatatcagggccatgccataaaactcaaagcaagtctactacggctcctacttacaagcacttgtgtttttgaccacattggctggtggcatatcggctcccaggagcaatcccttttatggcctgctgcaccctaggatgagcggggggccaggctggtgggaggggcaggaaactcatcatatgagcaaagtttaaacaagaaggcttcaagaaagcctcatagttcctgtcttcaggtgcctacaggcttaggggaaagctgagctagtgtcaaggtaagggtcagagggagctgattcttgctcaccaaaaccagca

SEQ ID NO: 78170 - DNA, 811 bp, Homo sapiens
ttttcagaaaattactactactaatatagtctttataatacataaatacaaactgattttgacttcgctgcttctaagggacattgtcccaaatcatatttcctcaaggaatccagtttctatttccaaatacaatgtataagtgtgtgtattccctctattcactgtgactgtggatcttgatctaaataaaattcaactctaaaaagaaatacagtgctctagtttattaaaacatggtttttaaaaatgttctctggggttgggtatttttgccgtagttctttgctttgattcttgggtagatgctgaatctcccaaatttggtttctctaactgtaaaataaagccagtatcacttgtcttgtggcatcgtaaggattcaatgagctagtgtatgcatactgctcagtaaataggaactattattagggctacttttgtattttttatgtttatggtgaagtctgatgtttttccatatttaaatttaggaagagaaaatcttgcatcagttgaaatgtttgaattaaataatctatgctagttcttagggtaaaaatagttacttaactgggctcttgtgaggtaaccattacaatttaagtaaaaatttacaaatgttaatcattaatagtttaatattacttttcatttcaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78171 - DNA, 968 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacaaaagaagacaaaacaaaaaaaaaagggggggcggcaagaagttcca

SEQ ID NO: 78172 - DNA, 726 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactataatgcattcatgggttgcacaaggtttgagatt

SEQ ID NO: 78173 - DNA, 305 bp, Homo sapiens
gatttcagccgtagaaagtaattttgtgccatgcgtggtggttcatacctgtaatcccagcactttgggaggctgaggaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78174 - DNA, 278 bp, Homo sapiens
  misc_feature (19)..(19): n is a, c, g, or t
  misc_feature (28)..(28): n is a, c, g, or t
  misc_feature (39)..(39): n is a, c, g, or t
  misc_feature (50)..(50): n is a, c, g, or t
tgcgggccccgcccggctngaatagacngtatttggaanggtttttcggngaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78175 - DNA, 266 bp, Homo sapiens
gtttaagttactgggactctctttagaagcacaaccaggaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78176 - DNA, 436 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggtactggattcatttttgcctt

SEQ ID NO: 78177 - DNA, 503 bp, Homo sapiens
  misc_feature (499)..(499): n is a, c, g, or t
ccttccaacatctcatttctgaggctggtattactttttcctcatattacagataaggaaaagatttagacagttcccgttcttttggaattgatagtctcatgtaagaggaactttaaggttgagacaatgtaaaagtacagtgttagagagatgaatagggtcatccaatgtggtttcaaggtgcataagatttttcctgaaggtaatactaacagattgggcatggggtccgagggtattctaggtggaaaggacaacttaaagtcttgttggcaagaaaaagatcggtatgtatgagaagccaccctctgctgttggaggtaaggtgtgttcccaaatgaaataagggagagacaggggccagatattggagctcctgacgtgccatactaaagaatttgattttagaggccgtcaggagtcagtgaaaggttttaaagtagaggaataagatgttggaaggggggatcctctagatcgaccgcaggcagcgagntgca

SEQ ID NO: 78178 - DNA, 358 bp, Homo sapiens
taaacccggttttttttttgggacaaaagggggcctaaaaaagtaaatttgaaagaaaggggagggttttaaccaaaaaagtggaaaaataaagggggaggggttttttaaaattaaccccccgaaaagggaggttttcccccgtaagggttttaaaaaattttttgtggggggaaggggggaaaatcccaaaacccagggacaagggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78179 - DNA, 269 bp, Homo sapiens
cggccggtaccccctgatatttctggacagaatgaaaacatgtttatgaaggttcacactaagtgaaagctggcatccaagttgattcagacaaaagtgaaagtcaagaagttaatagtacattaattctccaaatgcatgccagcagagtgtggcaggaaggtacacaagtcagcagatctgggttgtcctggttctcctattgactcgtgtgtgtgatgttaggtgggtgaatcttggctttgaatctccatttgtaaaataactct

SEQ ID NO: 78180 - DNA, 142 bp, Homo sapiens
gtccctgggtggttcagtcaaagaggtaagacctccagctggctcacccaagggacctggatttggtgtacaagcaggcctttaatttatattgaactgtaaatatgtcactagagaaataaaatatggacttccaatctac

SEQ ID NO: 78181 - DNA, 1112 bp, Homo sapiens
ccttccaacatctcatttctgaggctggtattactttttcctcatattacagataaggaaaagatttagacagttcccgttcttttggaattgatagtctcatgtaagaggaactttaaggttgagacaatgtaaaagtacagtgttagagagatgaatagggtcatccaatgtggtttcaaggtgcataagatttttcctgaaggtaatactaacagattgggcatggggtccgagggtattctaggtggaaaggacaacttaaagtcttgttggcaagaaaaagatcggtatgtatgagaagccaccctctgctgttggagaccttacagacaatttgtttctacaaaaatggaaagggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78182 - DNA, 978 bp, Homo sapiens
cggccggtaccccctgatatttctggacagaatgaaaacatgtttatgaaggttcacactaagtgaaagctggcatccaagttgattcagacaaaagtgaaagtcaagaagttaatagtacattaattctccaaatgcatgccagcagagtgtggcaggaaggtacacaagtcagcagatctgggttgtcctggttctcctattgactcgtgtgtgtgatgttagggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78183 - DNA, 1263 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggcgcagaatctaggcctgctctggccagatcagtttcgaagaccgtcgctccgaaggaggcacctctcgtttcaagcctagtgacctcgatgcttttaggttgcagcatactggagagctctggcttgcttcgtgaaggcttagggagaacttcattagggctggaaaagggtggccaatgtttgatttactgcagttgtgctttgcatatcggaaatgctggctaaataaacggtatcaaactaactctgaaagaacggcgccgcaaataacagcacccaattaaagaaccacaggattttagagattaaatgatctttttgagatccaagtacatctcatgggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78184 - DNA, 944 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacaaaaaaagaaaaacaaaacaaag

SEQ ID NO: 78185 - DNA, 978 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacctgatcggcaagactacataaactaaattacctcgaagcgaagtctcgaatacaaaa

SEQ ID NO: 78186 - DNA, 976 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacatgcgtcaggcttcctcttctcctgtgtcgagtcgcccaacctcgttcgtgcgaa

SEQ ID NO: 78187 - DNA, 873 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttgaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78188 - DNA, 659 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttaaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78189 - DNA, 454 bp, Homo sapiens
acgtaaacttatttgtttattctgctctgtgtacatcctcatgctaaccgtagcaacttgcagctctaagtattatgtcataatgacagaggaccattttaaagtcttctatctatggctgtgaagacatcattatataatctagttaacagttactctagtgtcacccattttcaatttccagatcgcttttatcaagatcaggttactgtgaagtaaaaatttggttaaattacaaatgttttgctttcccatctttagccacagccaagttttaagttaacatgatctttctataaactttgtcagtgctccctttaaacattatttaaaacacataattgttactgtatttccaactggtaagacctcaagcacactgtaggtttaaggaggatatggtagttgtctctagaagcctttttttttttttttttttttgtggaaagggatt

SEQ ID NO: 78190 - DNA, 357 bp, Homo sapiens
gtaggaggattgcttaagcccaggagttggagaccagcctgggcaacatagtgagaccttgtctctataaatatatcgatataaaagaaagtaatttaaatatgactattgttaattttttttccaggaggatttgacagctaaggatattgaagaaattattgatgagctcaaggctggcaaaatcccaaaaccagggccaaggtatgctttatttatatataggaagttttagtggctcacctaaattaatctttcagataaacttgatttaaaaaattttataccttaagttcataggaattggtaggagctttggatagtattatctatatgaatctcatctagagcaagaat

SEQ ID NO: 78191 - DNA, 465 bp, Homo sapiens
agggagagacaggggccagatattggagctcctgacgtgccatactaaagaatttgattttagaggccgtcaggagtcagtgaaaggttttaaagtagaggaataagatgtggtttctgttttggataggtcactggataggactgagggtggaatgggtttgatttggacccagaaacagggagactaagtagataagaggctcttgcagaatgctaggtgaaagatgatgaggatcagacatggtagaaagaaaagaaattagagtgcttgtagattttgtttcttttgtttttgaggcaaaggggctagaagtataaattgaaaagcagttttaatgaaaaagaacaacttgaggtagtggaggaccattgtaatccaggtttaatgtttctggaactctctttctctccctccctccttccttccttctctctctccatccgtctccccttctccctcccc

SEQ ID NO: 78192 - DNA, 733 bp, Homo sapiens
tggagtttcagaactaatttagtaaaggattgaaaaggaaggaggatacagttgactcatttgtacagagtatatgactcatttgtacagaatgaaaacatgtttatgaaggttcacactaagtgaaagctggcatccaagttgattcagacaaaagtgaaagtcaagaagttaatagtacattaattctccaaatgcatgccagcagagtgtggcaggaaggtacacaagtcagcagatctgggttgtcctggttctcctattgactcgtgtgtgtgatgttaggtgggtgaatcttggctttgaatctccatttgtaaaataactctcctgaaatagagatggatagggtagaataccatatttcttaagatcttttataagttgattccattgttgtaaattatgaatcctaaagtatttctttatgaaaaattttttaaggctatgatttactaaactttcttaaaattttaaattttagggaagacatgtaaggaatttgcataagacagctatgcaaaatggagctggaggagctttatttgtggtaagtaattacttagatttctttggaaagaaaagacttggaaattggggtaaatccattgtaaaaatccaaaatatcttaaataccattgtctttgatatatgatggtcatcgtgagaatttacatacagctaattgaatttactacatttcaaaagatgttggttccagttgaacctcatg

SEQ ID NO: 78193 - DNA, 921 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78194 - DNA, 645 bp, Homo sapiens
gacccacgcgtcgcggacgcgaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78195 - DNA, 887 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggcgcagaatctaggcctgctctggccagatcagtttcgaagaccgtcgctccgaaggaggcacctctcgtttcaagcctagtgacctcgatgcttttaggttgcagcatactggagagctctggcttgcttcgtgaaggcttagggagaacttcattagggctggaaaagggtggccaatgtttgatttactgcagttgtgctttgcatatcggaaatgctggctaaataaacggtatcaaactaactctgaaagaacggcgccgcaaataacagcacccaattaaagaaccacaggattttagagattaaatgatctttttgagatccaagtacatctcatggtaggcaaggaaattgaattgcagagaagttgaaacactccttcacgttaatctaaaaatgcagatttccagaaatgtcgattataacaacagggcctgttacacaagtaatactggaaagaagccttagttttgtttgttttctaagagtgaaataggttaagtcagttctcagcaagagggagctagtgtatattcattgagaatgaattcagggctttagagttagactcgagtttggatgttagcttaactgccttttgtggctctatgactttgtgctgttaatcttcctcagtttcttcagttgtaaaatgggaatattcctttttgcagagttcagtctttcaataaacatttgaagtcttactgtacgt

SEQ ID NO: 78196 - DNA, 1557 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactgggtaaggaggctcaagctgagcccggcgctgccgccgcccttctcttgctctccgtgtctcccttagttttgggcgcaggagagccctgggctctgcacgggcctgcaggcggcggcaaggacactgcggccttagccctcttagggaggccgctgcagccccaccgtgagaagccccgagggagggttgccatactgggaagtgtactcctagtttggtcgaggaggacagaaaagaggggctgcttggtgatatatatatatatgtttgtttgtttttgctgttttgctgtagcgcagaatctaggcctgctctggccagatcagtttcgaagaccgtcgctccgaaggaggcacctctcgtttcaagcctagtgacctcgatgcttttaggttgcagcatactggagagctctggcttgcttcgtgaaggcttagggagaacttcattagggctggaaaagggtggccaatgtttgatttactgcagttgtgctttgcatatcggaaatgctggctaaataaacggtatcaaactaactctgaaagaacggcgccgcaaataacagcacccaattaaagaaccacaggattttagagattaaatgatctttttgagatccaagtacatctcatgggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78197 - DNA, 1175 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacaaacacgatgacacccacaccacaaaccaaacaacctttgcgccggcagagccccgggaaaccctccccacaccatccgtcggggggcgcggcccccaggtacgtcacctcgccacacgctccaagcaaccggcccaaacgtggggactcccaaaaaaagcccggggacgcgggtaaaccgcagggtcggcacggcacccaggccgggtcgttacgcccgggagcgggagaacaaggccaggagaaccggaact

SEQ ID NO: 78198 - DNA, 760 bp, Homo sapiens
gtaacattgctttgttgtacttttgaacaagagctcctcctgatcactattacatatttttctagaaaatctaaagttcagaagagaatgtatcactgctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctac

SEQ ID NO: 78199 - DNA, 973 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctaccaggatgcggccgccccctccttaatttaaaatcatatcacagaggggcggg

SEQ ID NO: 78200 - DNA, 811 bp, Homo sapiens
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttgggtagggaatacatgatatttgtaacactgataaaaagtagaattgtctctctagatttggtacatttctatctaaaatttccaacttctgccatcttattggatctgtacttacctagtaatattttgtgttactgtgtttccacatctttatttcttcctatttggtattcttcctcagttcttagtgttaaagctgagtttttaattttttcttttttaatcagt

SEQ ID NO: 78201 - DNA, 325 bp, Homo sapiens
ctttaaagaaaagaattgtagaattgactgtcaggcgataccatttcttcctgtctattcctcggactctacctgaaatatcaaaatagcagaaatagataagaataaggtatttggcagggttttcatattgacatttcagtctcagtttttttttgtttttttttttttttttttactaatagtcgtatatctctaaaagattttcagaggagttgataacaggaatgtcagaaaacagtatattactgtcaagtgtaggaaaatagctttttgtcaattccttgatgaatttaacacagaatgcttttacatttaaaaaaaa

SEQ ID NO: 78202 - DNA, 604 bp, Homo sapiens
gacctcttgacgccacttgggtatagggcacatttataaccttctaaccccacccataaagtgtaggttaacaagtgaagtgggaatggtaaacattttgaaatatctgccacaggaacaattcccattttcttcattaatataatggtggaagaatattgagttcagaatcagatgtggctaacattagatcttttgcttattgattatttagatcctgggcgacaaagagacacctccatctccgaacaaacattagaaaccaacaacattcaaacagcaccaattgttgtaaaaatgatcttaaacattttttttggtattaaaactagtgttcacaatagaaatttgtttaaattgctgccttatagagtctttgcatttggtctgtgtatgtactattgtcttagtgataagttttctcttcaaattaattggaaagcttgctgggtgcagtggctcatgcctgtaatcccagcatttttggagcacaggatgggggtatcacttggggccaggagctctcatagggagacccttgtctctacaaaaataataaataaaaaaattaactgcgcgtagcttgtgtatggagtcataacaa

SEQ ID NO: 78203 - DNA, 803 bp, Homo sapiens
aaaacttaaagtataatttttaaaaaaaagtaaaagagaaaaaaaaaaagacagaatcttcgctcatgcacttacctgctttttcttctgtttactcaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaattttaagtcctttcgtataagaattaatgagacaattttcctaccaaaggaagaacaaaaggataaatataatacaaaatatatgtatatggttgtttgacaaattatataacttaggatacttctgactggttttgacatccattaacagtaattttaatttctttgctgtatctggtgaaacccacaaaaacacctgaaaaaactcaagctgacttccactgcgaagggaaattattggtttgtgtaactagtggtagagtggctttcaagcatagtttgatcaaaactccactcagtatctgcattacttttatctctgcaaatatctgcatgatagctttattctcagttatctttccccataataaaaaacgatcggcacgt

SEQ ID NO: 78204 - DNA, 1034 bp, Homo sapiens
ttttagagcgaaacaccaaagatttctctgaagcagatctccaggctgaagtgaaaacgttcatgtttgcaggacatgacaccacatccagtgctatctcctggatcctttactgcttggcaaagtaccctgagcatcagcagagatgccgagatgaaatcagggaactcctaggggatgggtcttctattacctgggaacacctgagccagatgccttacaccacgatgtgcatcaaggaatgcctccgcctctacgcaccggtagtaaacatatcccggttactcgacaaacccatcacctttccagatggacgctccttacctgcaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaattttaagtcctttcgtataagaattaatgagacaattttcctaccaaaggaagaacaaaaggataaatataatacaaaatatatgtatatggttgtttgacaaattatataacttaggatacttctgactggttttgacatccattaacagtaattttaatttctttgctgtatctggtgaaacccacaaaaacacctgaaaaaactcaagctgacttccactgcgaagggaaattattggtttgtgtaactagtggtagagtggctttcaagcatagtttgatcaaaactccactcagtatctgcattacttttatctctgcaaatatctgcatgatagctttattctcagttatctttccccataataaaaaacgatcggcacgt

SEQ ID NO: 78205 - DNA, 925 bp, Homo sapiens
  misc_feature (26)..(26): n is a, c, g, or t
  misc_feature (30)..(30): n is a, c, g, or t
cacagcgtctcatcactctccaccanatcnaccgccccccccccctccatagcctgcaacgaccctcttaattttccaccgctacagggaacacctgagccagatgccttacaccacgatgtgcatcaaggaatgcctccgcctctacgcaccggtagtaaacatatcccggttactcgacaaacccatcacctttccagatggacgctccttacctgcaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaattttaagtcctttcgtataagaattaatgagacaattttcctaccaaaggaagaacaaaaggataaatataatacaaaatatatgtatatggttgtttgacaaattatataacttaggatacttctgactggttttgacatccattaacagtaattttaatttctttgctgtatctggtgaaacccacaaaaacacctgaaaaaactcaagctgacttccactgcgaagggaaattattggtttgtgtaactagtggtagagtggctttcaagcatagtttgatcaaaactccactcagtatctgcattacttttatctctgcaaatatctgcatgatagctttattctcagttatctttccccataataaaaaacgatcggcacgt

SEQ ID NO: 78206 - DNA, 405 bp, Homo sapiens
gatagggggcacagcctgaaagatatgccggtgctgcatatttggctgtctgcttcctacatgactacctggtgtctgctgccagctgttttgtcccatgggttgggtgacctctcagtcctgcagttggcctggagagtgggcatgtccactaaattaacagctgacagtagttggaggcgtcacctctgattgactgcatgttgacaggggatgctaacaggatgacagggaggggacaaagtgtaggggctttgggagtagggagtttgccctgggctgttccagttgcactttacactacagcctatgtctgcactctgatacatctatccacttccagctgccctacatccttccctctccttcagctggtcttgccaagcttctccgcggcttccacag

SEQ ID NO: 78207 - DNA, 322 bp, Homo sapiens
gaagatgtactctgtaaaataacaattaaaaaacatagtaaatacataagccagtaacacagccatttattatcaatatatgtactacatataaatgtatgtacatgctatacttttatacaactggtagtgcgggtttgttgacaccagcatcatcacaaacacagtgagtaacgcgttgcactactatagtgtgggatggctacaactcactagggaagaggaattttctagcttcattataatcttaggggaccaccaccctatgtgtggtttattattgaccaaaacattcctaaggggctcatgattgcattctact

SEQ ID NO: 78208 - DNA, 438 bp, Homo sapiens
gcctcccaaagtgctgggattacagtagttcatcagcccagcctccatagactattttttaaacaattttactcaggtataagtcacaccctatacaattcacccatttaaagtatatattcagtgagtcttttagtatattcacacagctttgcaaccatcacaaaaaaaaaaaaaaaagttatttctgtcccctatggcttgaagggcactcatactcatagttagcagaatcttcaataatactagagcttaaatgggagagagtcatacagtagatgcttgaaaatgttcaaataaatgaaggccaggaggctggatgcagtgactcacacctgtaatcctagcactttgggaggccaaagtgggaggatctcttgagcccaagagtttgagaccagccctggcaatatagtgagaccaagtctctataagaaa

SEQ ID NO: 78209 - DNA, 352 bp, Homo sapiens
agacgtaagacttaaaagtggaggggtcgttattttagggtgatggtcttctctgtttatcactgactcattcattcagcaaatattaatgacggtcaacttaagaaaggctgatataaaacagttaaagacatgaggcttgaaaataaaataacttttcggatgttggtcttctctattcatttgttcactgaatcactcgttcagcaaatatttatgaagggttactgtatgtccattagaagctggagatagcagtgagcaaaactgaacagtttctgccttctcagattttacaggctaattaatgctggggaaaaaccctaattcagttgactcaacaaatatttac

SEQ ID NO: 78210 - DNA, 422 bp, Homo sapiens
tgagacagagtctcgcgctgtcgcccaggctggagtgcagtggcgcgatcttggctcactgcaagctccgcctcccgggttcacgccattctccagcctcagcctcctgagtagctgggactacagatgcacgccaccatgcccggctactttttgtatttttaatagagatggggtttcaccaggttagccaggatggtcttgatctcctgacctcgtgatccgcctgcctcggcctcccaaagtgctgggattacagaattactatgtgtccagctctgtctgtataaataaaacagctaagcagaggatactgcaaagacttcggttgctaccatttccttactcagcatcaccaattcatgaaatctgctcttcagataaaagcttttgccatttagagaggaaatgattagcttgaa

SEQ ID NO: 78211 - DNA, 194 bp, Homo sapiens
ggaaaaattaaaccactgaacaaaaatcattctaaaaattttagttcagcagcaaaaaattagagcttgccattttgtcttgagatgtgtattttgttgagttaaaatttctaaagtctgcctatacgttttccatctccttgctgtgtaaattactgaataacttggggtaaaaaaagaaaatttatgtaaag

SEQ ID NO: 78212 - DNA, 581 bp, Homo sapiens
caagtacctggatgtttcaattgaaggtactgtatttactcacccttttcatacctctctgtgagagcaatgcattctagctgcttctagtcagccatcttggccactccctccaaattcttaaaaattatttaaatctctttgttaaatttctaaatttagtcatttattattttctatatgttgttgagttgttcctgtgtaatcttatgaagtttgctaagcttccttaaaataattatttttaacctgggtgtggtggtgtttacctgtagtcccagctactcgggaggctgaggcaggagaattgtgtgaacccgggaggtggaggttgcggtgagccgagattgcaccactgcactccaacctggtgatagagcaagactccatctcaaaaaaagaaagaagataaaaatccttggtaacttcaacacagctttacgttggtgaagattcaagtgctattcgaatgagttcagagacaatagactaaaaggagttagagttggtgcatataggaaaccctcaaccagttttgttgtaaagtggaatagataaatgaggcagtatcttgagagata

SEQ ID NO: 78213 - DNA, 932 bp, Homo sapiens
tgtttgtcattgtaccaggattgatgtgctcggtgcccagaaggcagtaagctctgctccctagcagccttggatacggtttgccctggcttgaggatgtgctctgtgttgtttgctcatggcactgtagaggactgttcctccaagcacttccttctcttccacaacccatcttgaaaccagagaaccagcaggactaaggatggaattgaaaaaagttgatgaatttatgtttcatcttccatctctacttcttctcctggaggtgtgaacgaataatgaaactgctaaggagaaaggcagcatgaaagaaggaggctgcacaattggaccttgcaaattcaagatctagatcattagctgcaaatctgagttggaggtgctgaatactcattcacacggtcgtgctcatagcagcagcgagattttttttcttgtcacgatgaacagagtgtcctgacaccttgagacattaggtgcttgcagaacatagtgtgaggtgacaagggaagggacttgcccttcacctccacaccactccaaaaagccctaccatcgtgcaaaattacatacacaatctcatgccacaaaatataaaccaaccactacatttaagaaattcgatttctcccccttaactgtcccctgtgctttctgagcacatagcatatttttccctaatcttaaaatttagctttaaagttcactgttaaggaactaagcagttttttagtcaagagatatatgctggtttaagatacacaaaaacttgaacagtacttgagatcttttgagaggaatgagcaagaaatcagatatttgccttttcatcttctgtagactcatacagcatcttctacatagctagggactcaagaatgttgaatctccaagctaaagcatctatcaaatgttatttacataaatagagc

SEQ ID NO: 78214 - DNA, 363 bp, Homo sapiens
tagcctggctttaaaaaactagatgaatggcatatgtaggatgatattaaaatattatcctggctgttaagtagaggagattgaaggaaagacttggtcagagtgaatgtgtagagaccaagtagcaaataatttttgtcgtctgtatgagggatgatggtgcttagatctagggtggtgacagagggtttagagagacactaagttttttgttttttttttttgagacagagttttgctcttgttgcccttgctggagtacaatggcgcaatctcggctcattgcaacctccgcctcccaggttcaagcagttctcctgcctcagcctccctattgtctgggattacaggtgcccgccacca

SEQ ID NO: 78215 - DNA, 799 bp, Homo sapiens
caggcctgcagaggggacagcagagagtggacagccagggttgggggttttgccaaactggcttaacaccggcagagagggaaaggaagttgaagggagtgaaaatacaacatggacaacggaacctaaactggaccaggaggggaggggagagaagcggggggcactgggggacaccaaggcaaaggtgggctcggcatgagaggtctccttgacatcaaaggcttggagcagtgacagcagttggacaatgtgttggaagacaggatacagtggacagagagagggacatttgaaataggctgtggaggagacacctgccatccctggtgaggacaaattctcagatgtgaacatggaagacagcggcagaaacccattctggggcagggcctggacgagtccacgtagacagtgaagtttaccagagagctgtgaagggtggtgggtggtgagtcagagctcaggtttctaattaatgatgagtgggagagtgacaggcacaagatgactggtatagtcaggtggctcgagctgcccaggagctgggtgagaataatagtcccaaacaccttccatccaaaggtttcctgcctctgggttatttattcactaaagctattgagcagtacctgcttggcacagagcatactacttttactactagtaaaaatggccaggccaagccctgtggttcatgcctacaatcccagcacttagggaggcagaggcaggaggatcgcttgagcccaggagttcaagaccagcctggcaacagagcaagatgccattttccaca

SEQ ID NO: 78216 - DNA, 853 bp, Homo sapiens
agtagtgaaaagctgaaagctctttaggaaaacaagtgtgcccactctcaccatttcttttcaacaaagtgatggaaatcctagccagaacaattagacaagtaaaagaaaaagcatccacattggaaaggaagaaattattttttttctgtttgtagataacatgatcttatattttaaaaagactttaccaataaactgtttgaaataataaattaattcagtaatgttgcatgaccccaaatcactatttttaaaacattccatgtacttttgaacaaagttatattatctgatatttgggtgcagaattttatgaatgcctattaaattaaattgcttacatggtttaaatcttctatatttttactgctaagtatgaagcagaacaataattgaaataactgtatcaaaaccacccaaaatgatgtttgtctactggtcactatacttctatgaattttgtaaatacattcgagaatttatttcatgaaatttcatagttgttattttgacctagtaaattgtactttttaatcatatattttgtatgtataattcaaaatcaattcaagaaaagagagaaaaaacataaaactcaatattatatatacttaaaaatacatatttaaaaatcttggttaatagatatgtaagatatgaaagggagatggaaaacaagaagtctattttaacaatgaagacagtttaactaaaaaataaaacaggaatggtacctcattcaaactagtaaattgccataaattgaaggataagactcactccttgaactatgtacctaaggcccaagagaaaaaaagaggctgggcgctgtggctcacacctgtaatcc

SEQ ID NO: 78217 - DNA, 349 bp, Homo sapiens
gggtgtagaaataaatgaagactatccaaaagagagcaagcagaggtcattgattcagagcttgccctagcaaagagtcttgcatttggcagaaactcacaggctggcagaacagtgaaaaaggttcacactggaaaagagagaaggcttcaggggtgcctgattggaggtagttggcgtaggaaagctggaagtgggctcattagaagtggggcatccggctgggtgcagcagctcacacctataatcccagcactttgggaggctaaggctggcagatcccttgagcctaggagtgcgagaccagcctgggcaacatggcaaaaccctgtctctatgaaaaaaaaac

SEQ ID NO: 78218 - DNA, 1534 bp, Homo sapiens
  misc_feature (1370)..(1370): n is a, c, g, or t
  misc_feature (1384)..(1384): n is a, c, g, or t
  misc_feature (1419)..(1419): n is a, c, g, or t
  misc_feature (1431)..(1431): n is a, c, g, or t
  misc_feature (1433)..(1433): n is a, c, g, or t
  misc_feature (1441)..(1441): n is a, c, g, or t
  misc_feature (1445)..(1445): n is a, c, g, or t
  misc_feature (1489)..(1489): n is a, c, g, or t
agacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacaccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaattcaagtatctgagccagatgctgcgggaccttgcccagctgcccgtgtgcctaaccccactggaggccatgggacagccctgtggagccttacaggacgagcaccaggggcgcagtttnggtggaggggatgncagtggcccttcggcgaagcggctggacatctaancaggccaggggngntttgctgngttncatgctgttggggagaagcaagaaaatgggcggccagaatgtgnatggacgaggaagcggtggttgaccgtggaaaggggcgggatgcc

SEQ ID NO: 78219 - DNA, 1202 bp, Homo sapiens
  misc_feature (1038)..(1038): n is a, c, g, or t
  misc_feature (1052)..(1052): n is a, c, g, or t
  misc_feature (1087)..(1087): n is a, c, g, or t
  misc_feature (1099)..(1099): n is a, c, g, or t
  misc_feature (1101)..(1101): n is a, c, g, or t
  misc_feature (1109)..(1109): n is a, c, g, or t
  misc_feature (1113)..(1113): n is a, c, g, or t
  misc_feature (1157)..(1157): n is a, c, g, or t
atctatcagcatacctccagccgttacgtgcgtgagctggagctgcggatgcaacactataccttactataccggtcactcccgatctagctctaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaattcaagtatctgagccagatgctgcgggaccttgcccagctgcccgtgtgcctaaccccactggaggccatgggacagccctgtggagccttacaggacgagcaccaggggcgcagtttnggtggaggggatgncagtggcccttcggcgaagcggctggacatctaancaggccaggggngntttgctgngttncatgctgttggggagaagcaagaaaatgggcggccagaatgtgnatggacgaggaagcggtggttgaccgtggaaaggggcgggatgcc

SEQ ID NO: 78220 - DNA, 424 bp, Homo sapiens
cattttttccctctagtgttagaataaaccagagttccctggattgggcaccagatgaaatgacagatctggggtaaaatctgtcttgcagggaacatacgttatctttagattctaaaatcaaaccaaattcagtaaaatgttcacaatataaaacaggaaaatcaagactgaggatcaataaatcatctcttaatttagaatcaccaggtgaaatggaaggtaatcaaacatattctctcttgcatatccagtcactcactcctctattaacctctagccctgtgtttccttatgtgtataatggcaataatatctaatttaaggggtgctggattaaatgagataatatatatacaagtcagagacacagcaggtgttaaatagtagccatgtcgagggtggtaaaattgatgctgctccc

SEQ ID NO: 78221 - DNA, 391 bp, Homo sapiens
gcacaactgaatatatattaaaaactggtaaaagaatatcgttttaaagtaattgataattatgtaaaattttactataaatcaaagtgattttttaatgttagtagctatttatactttatagagcaaatctgatttgagaattaaataattttttcctaatttgaagataaatgttatttaaagattataaaatatctaaatatttttgagtatacatacatgcacatatatatgtacaattaagaatatgtatatatgttactttcatgaaacatgatggctaaatgaaagtagagttaattcacgagcagggaaatacccagtcttccagccttgtcgtctcggccattcattcccttgagaaggcaaattttgttcagacacaaaa

SEQ ID NO: 78222 - DNA, 802 bp, Homo sapiens
ccctcgatttgtcctcttgctccttcctgctaggacagcagggcttctcgtacacatgctgtagcgggcactgccttggcaggaggatttggggcttccacatatcctgttctcaagattgtagcatctcagtactctagagcccagtacctgacatcaaggatgtctggagcttccttttaaggaaagaaaagatcagcaaacttgcctgttcccgtttacacttccaccaccagttcgtgagagttcctgttctgcatcctcaacactagtattaagtgagagttcctgttctgcatcctcaacgctagtattaagtgcactggcctttagtctgttaaaaagcatacaatggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagcctctaaccctttgcagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctggtgggta

SEQ ID NO: 78223 - DNA, 743 bp, Homo sapiens
gaagtaagcaaccgtgcattaaaaagctatgaaaagatgaagagaatatgccttcaaatgggaaggaatacttaactgtgaataagacctagttcaacatggaacttcctggtggccaagtcagaagagaagcacagtgagttttctaactttcataatgagaaaagagaaagcacactgtttttcaaaaaagaaagttattacccagtcactgaattctaaaagaacttcatgcttgccttgttcatggacttcaaataatttaattatttaaaataattattttgtctaaaattctcatgtgtctctgttaattataacatgaataatagcatttacattatgcataaatgaagacaatagtatatcttctaatagctgtataaaccatctactaagctgtcaagattaattgacattaataaaaccactgtctcacagagttccaaaaatatggattctctgtaagaaagtttcttctttcagtgtcagaagaaaaaattaaagattcctggatctgcttgtttggcattatttgataaaagtgaaagaaaagaagaggctctacaggtttctgaaatatcaaatgctgtggaaatatttaaggctaaatgtcttttccactagactacaaataacagctatattttctcaacacttttattgaaatatttttattagatgtgtgcacatttttgcccttatctgattattttaaaattggcaggtgactttctggggaa

SEQ ID NO: 78224 - DNA, 531 bp, Homo sapiens
ggctaagtgcgagcaggcgcgtgtgacgtcgggaggcgccgcggctcctcggccgccccactcggtggtcccctgtctggatccaaactgctgactggctgacccgagtggtcacatttgccctctggggcttttgaaaaccttaaatcaaaattgcttttgaatctgacaactcctgaggctactttcgcggcctcggggctgtttcatataaggacgcgagttttcctgatcaggtctgtcggccacgttacgatttccaatttgcgatccatcagttacttccattgggtcttcagcccccagggactgtggatcctagaccccgcggagaagcccgtggactggagctgtgtcagctctgatggaacaaaaacggaggcacagagaggtcaattgattggtctaatgacacagatctagcaagtggtggaaccaggactgaatccaggtaacttgctcctgatgtttgtccattggtgctctcatacttttttccctctctcttcctgttagaatgtgcttccagga

SEQ ID NO: 78225 - DNA, 719 bp, Homo sapiens
  misc_feature (596)..(596): n is a, c, g, or t
  misc_feature (635)..(635): n is a, c, g, or t
ggctaagtgcgagcaggcgcgtgtgacgtcgggaggcgccgcggctcctcggccgccccactcggtggtcccctgtctggatccaaactgctgactggctgacccgagtggtcacatttgccctctggggcttttgaaaaccttaaatcaaaattgcttttgaatctgacaactcctgaggctactttcgcggcctcggggctgtttcatataaggacgcgagttttcctgatcaggtctgtcggccacgttacgatttccaatttgcgatccatcagttacttccattgggtcttcagcccccagggactgtggatcctagaccccgcggagaagcccgtggactggagctgtgtcagctctgatggaacaaaaacggaggcacagagaggtcaattgattggtctaatgacacagatctagcaagtggtggaaccaggactgaatccagagaatctggaagactactctgccaagacatctcaaaaagtgtgtgtccggaattggtgggttcttggtctcactgacttcaagaatgaagccgcggacccttgcggaactgtgaagactagagtgaccttggagatctcatctgnaagatggtagaactgctatcagcctggcttcccaaatgncctcctggatcacagctaccccatggcctgaaatgtttgccctgggagttgtgccattagaaaagaaataactttctttgttct

SEQ ID NO: 78226 - DNA, 488 bp, Homo sapiens
  misc_feature (365)..(365): n is a, c, g, or t
  misc_feature (404)..(404): n is a, c, g, or t
gaagtaagcaaccgtgcattaaaaagctatgaaaagatgaagagaatatgccttcaaatgggaaggaatacttaactgtgaataagacctagttcaacatggaacttcctggtggccaagtcagaagagaagcacagaacaaaaacggaggcacagagaggtcaattgattggtctaatgacacagatctagcaagtggtggaaccaggactgaatccagagaatctggaagactactctgccaagacatctcaaaaagtgtgtgtccggaattggtgggttcttggtctcactgacttcaagaatgaagccgcggacccttgcggaactgtgaagactagagtgaccttggagatctcatctgnaagatggtagaactgctatcagcctggcttcccaaatgncctcctggatcacagctaccccatggcctgaaatgtttgccctgggagttgtgccattagaaaagaaataactttctttgttct

SEQ ID NO: 78227 - DNA, 577 bp, Homo sapiens
ggcacgagaaaatacacattgggtttcaaagacagtatgaaaagatgtctgtaaaataaatcattaaccatttctaatattgattacatgttcaaatggtagcattttgaatgcactgggtttacaaaatacattagaattaatttcactggtttctttttacttcttttcaatgtggcttctagaaaattttaaatttcacacatggcttacattgcatttctattggattgcactgcaccagagtggtcactgacttctcagacctgatttctactgaacagacgactcaaagtagtgagggccgtgggcttctgaggacctcgggaggatggggtagttctctaagaggctggtgaggacaaggcaaatccttactgacttcctcattcatgttgaggtcttgctgtccttacccaccccagccctgatattactttgctttagcaaagctttgcccagaaaaatcagggaagggctggtctttggaaagaaggtgaaggtaaagccacttgtacagggagaaactgaggcagagtgggtcaatatctcccaacattatattcatgcctgagca

SEQ ID NO: 78228 - DNA, 698 bp, Homo sapiens
gctacagatgttgaacaggtatgcagggaccagtttctatgcaccccacctttaggacttgcaactctagttcacgggtctcagagaagttgtaagttaccagtttccaacattccaaattactgcaaatgccagaaactacaaatgtttggaaatgccaagagtctgaggatctactgacacagcatatagctgaaacctcacccacatagtgttaagaaagcgtttcctgcctgtctggggctgacaaaccacaacaacccttttcttcttcctcaggcaccaagcaggactcatcaggacacctgggctcaggctcaaaccctatcaaagcagggctgtactgaggacgcaccttcattctcttcccagaacaagtgaaggaaataggagaggatctttgctctaggaaagcaggcttcagacaggaagtggcaacaattcatacaaggtgccattctttcctctaacccacaccttaacctgtgttgaccatctccctctctcatcacaatatctctagattcttccacatacttattgaaaactatgttcatgacacgacagaggaggtaactgtctcagatagcataagaagttcaatagtaaccaaacatttttttttaagttatttccagtgggcctgtgtgctttagctcacttaaatcttcacaacaccactgaggcacagagatgtt

SEQ ID NO: 78229 - DNA, 615 bp, Homo sapiens
gaaactttgaaaggcctcaaagctgtccaaatagttattacaaaagcagtatactaacgtatttgttctattcattgaacagctctgaagccatcacttagatctttttttcctcagattctttttattcttaccttattcataattctatcaaaaataggttatctagattcttagattggaacaaatgagaaagtagtacaactctataatcaggaaaatatcttaacaaatacttaaatttagggaaagaagcactttataagcaaagaataataagcatactagtatagaactatttagcgtaggtaatcagatatatctcacaacgctagggactgtacaatatttagtatttataatgaatattgaataatcaaggaatatttctgtatagtatatccttttaagaatataaggagtgtaaactatatgaagatttctaatgtaagtttgtgtgtgtgttttaatgtctggcacttaaactgtcaaatattgcttatttagaaattcacttattttatttggtatatctgattccctaatcatgctacactaataaagctgtgaaatacaataaagtattaccctttaccaataccaaactatttaata

SEQ ID NO: 78230 - DNA, 577 bp, Homo sapiens
gattttgaaagattttcgtaactacaggtaggtcagagaatatattctttgaagataaaaagcacaacgtgcattactcaaatctcaacgtcagagctactgttgaatttaggtttatgtgaaaatgtgcatctaaagtctacttgaaaccctggtaatatacttttttttttaaagactgttaatatggacatgtttttagtaaggtctttaaagataactttaaagataaattaagagttgacacatcagtttctgaatgtggaagtcatttatcatgtaactttactgaaattaaagagagaatgcttctgagtgtcacaaggataactaaaagccacacaaggaggactgctggcccatttctctagttcacaggttgtgctcagctttagaagcccacacacgggcatccaaactgagtctctggaatagaaaaattaatgatggacttcctcccctatgtaaccttggaaggttttaagttacaccttggggaattggcaaatcattttcaacatgtattataaattatatgatgttaaaattatttttaattttttaaagtaaaagaaat

SEQ ID NO: 78231 - DNA, 899 bp, Homo sapiens
atcagaataggccgcacttggcgcttccctgtagacacaggatctgtgagtttggacagatttctggtcagtttggaaggaagctggcctctgttaacagagcaccccttatgggtcagtgttgtgcaggcagtccacatacactgtgtgtatgcgatgacagtgcgtctgcttgtagaaggggctgggtcccctctgcagagcctccgcatggggctgcatgactggttccggccgacttgctggggagcgcacagcctgtccacaaagggaatcttcatccttcctgatctgtagagccatttgcaatgcgtgatggcaactgcttaacttcagttttcgtccctgggccagagatttctgtgccctgggataataaacgtattatctaaagagcttttatttctttctagagaataaggaaaatgatactctgcagaatttctatttcttttgtaattatctcaggggaaggtagttattaagtgttcactgattaggattaatgtttccaatttttgtcaagaacagaatgtatgtattactaatttaaccataatttcaatcaaaactgtgtcattaaaaatgttggcagtcatgcatttcctgcatggttatgaattttttcatgtatctatagtatttttctaacagtctaattttaattcattcactttctcacgaaaatgtattttttttccatttcagcatgtagtacttgtgttaccttttcacgaggcccacactcctccaaggaggctgctgattgtctctaaactgattacctccatttgttctttccttgatcttacagtgtccatcagcttcctatgattgaagaaaagcttccacttgtaataaaccaacttctctcatccagttatcaacatagaccaaaa

SEQ ID NO: 78232 - DNA, 470 bp, Homo sapiens
ccataaattagaaaaaaatacaggctgaaaagtcaatgaattaaactttagcttaagaaaataacaaaacgaacaagaagatctaacctacagtaagtagaaggaaagaaataataaaatgagaacagatataaagtaaattaacaataattgtgtgaacaagaaatcaacaaagcctctaagttggttctttgtaaagaataataaaattgattaatgtctagcaaaactcattaagaataagggagtaaaagcacaagtatcagaaaagaaaatggggcagtactacaggctctattttagacatcgcaaagagcaaaggaagattttgtgaatgactttatagcaacgtatttgactatttagacaaatgggcaaattcctagaaaatacaactttccaaaactgagcaaggaagatataattaatctggttctgatatctagtaaagaaatttaatctattattta

SEQ ID NO: 78233 - DNA, 396 bp, Homo sapiens
atttatttggagaaagggtctcactctgtcacccagcctggagtgcagtggcatcatcttggctcactgcagcctctgccttatgggctgaagcaatcctcccacctcagcctcccaagaagctgggactacaaatgtgtaccaccatgcccagctatggtgtatcttttgtagagatgggttttcaccatgttgcctaggctggtcactagctcctgggctcaagggttctgctacttcagccccctaaagtgctaggattacaaatgtgagctgcctcatccagcctaatttaaattttaaatgcaacatctgggtagaggttactgtattggacggtgtcttcaaaggcgaacagaaggaaaagaaaacaagtggtagaactgtttgtgtgct

SEQ ID NO: 78234 - DNA, 236 bp, Homo sapiens
gcagtggcagcaccttcctgtcacttgtcttgtcactccccgagtccactgtgagctagaaccacaggctcccatgaagaaggagccagaaccacaggccccatgagcccaggtcccacagcccgcaccttcgtcttccagccagcctctccggagctcagtgtgggtggaggggctgtctggcctcagaaatgggcaaaagacagctctcgttgtcagcgaggtaaatctagcgc

SEQ ID NO: 78235 - DNA, 362 bp, Homo sapiens
agtcctcccaccttggcctcccaaagtgttgagattacaggtgtgagccaccttgccagacctgtttttaatttttatgttttatttttgcagagatgaggttttgagttgttgcccaggttggtcttgaactcctggccttaagtgaagatcctcattctttcaagattgatctatagattcatgcaatcctaattaaaatttcagcaggcttaaaaaaagaaatcaatagctgattctaaaatttatatgaaaacacaaagaatctagactttggaaagtagaagttagagagcttacactacttcacttcaagtcttactgtggtaatcaggacaatacagtattggtgaaagatcagt

SEQ ID NO: 78236 - DNA, 299 bp, Homo sapiens
ggtgatgaggagagggcggcctgagcgtgagggggtgggcgtcagctgccggagaagcttctgccaggcaggagggacgagcgggcccccagctctgacctctcggcttctgttcatgtttgaaaatgaaatcggtggtttgggtggtcgtcagtttcctgtggccgacagaagaaagcaccacagctgggccttcaaacaacgagaattcacccactgagtcctgggagttaagagctctgcagtcgaggggcccgtagggccacgctccctccaggcttcccagaggggctccttcc

SEQ ID NO: 78237 - DNA, 558 bp, Homo sapiens
ttgcaatgggaattcagtatgttttcaattctatcataattaaaagtctttgcagttgtaaatgccacctttaggttaaatataaaccaagcatctgtcagcatcaatgtaagagagcaaataatgccttaaatgctaagagagtaaaactcaaactgcattgaaatgagcttgtcatctcaatgaacattcataaacacatccctgtttagttctgtgaaagagtagaattaataagtacatatattttcacatagtgattttatatatatatatatacatatatatatatgcctttctttagagttgtgctaaacagtgtgatttttctaatgcacactgctctgtccccttctcctctggttcctgttgcccagaatgtccttcctgtggaatagatcccgggagtcatctctcctaggaagctttctgtgaccacccctcctctgagaggctagacctcagtgcttttagagcacatgagtatctccctgtcatagcattttcaccttctctattgacttgtgtgcctcatccatgagacttaagtgttcctta

SEQ ID NO: 78238 - DNA, 222 bp, Homo sapiens
ctaatatgtaaaaatgaaccccaaagatcctgatataatttatctaaaatataattgtctaaaatataatttggacaaattattttaccatataaatgacttcatcaattttcagatatcctgcccacattggccaaattctacattttgtggggaaagggaaaagaagaaatagacatagagatggccaagtgctatggtttggatatggttgttttcacc

SEQ ID NO: 78239 - DNA, 379 bp, Homo sapiens
ctgcaggctagcaaaattatggagatgaaacagaataattctgaagaaaacacgaatgtttgaaagctgttatgttgtatgggttgatcatagttctattttattaacaagggaatctttgaaaaactgtaagcaaatatggtagttttaaagttgaatttttttttttttggattattgttgcttctgtcttaatgaggaatgattttgctcctctttaagtctcttggttccttagctcagatatcctagaattttgctgtggttgtatggctgggaaacttgggaaagagaaagcagtcaatttggagctatgcctaaccagagtaaaattcctgacagagaagggaaattattgagaccacaagagtccccctcc

SEQ ID NO: 78240 - DNA, 410 bp, Homo sapiens
taggctccgtctggtctcctgctcagggaaagccatttctactctccccagaagccggggccacgttctgtactcctggcctctgttctgcagcatgttcccaagcctggttgttactgcctcttccctagggtgaagaggggctgctatgggtggaatctgaggcctctgctggcagaagaaggggcctccttacactctattgctgaagcatagggaccccttctccaaatcaggccagctccttctgtaacccatggggtctcctccatctgggccctagtactactgtgtcctaagtctgaagggttggcctagagccagtccaggctggagatccctttcaattatttctgggatgcagacattgttttgtgttattgtttttacaatttttatatagtttttta

SEQ ID NO: 78241 - DNA, 203 bp, Homo sapiens
tgcctttctttgtcccttttgatcgtttttggtttaacgtttgttttgtcagcaattagaatagcaacccctgttttgttttgtttggtttttttttctatttgcttggtagatttttctccattcctttactttgagcctatgggtgtcactgtatgtgagatgggtctgtggaagatagcagacagttgggtcttgcttct

SEQ ID NO: 78242 - DNA, 582 bp, Homo sapiens
caggcatgcaccaacacaattggttcacttttgtatttttagtagagatagggttttgccatgttggccagctggtctcaaactcctggtctcaagcaatccacccaccttggcctcaagcaatccacccactttggcttcccaaagtgctgggattacaggcatgaaccaccatgcccaggtagcataatgttttgaggttcattcatattgctgcatggatcagtcttcaattcctttttatagctagataatattccatttcatggatctaccacatttcgcttctctgctggtgctgttttgtacctcatctacccaaatacaaaacttgcatttccatttccacaacaatccctgctcacagtttcctcatggggataatgatacttcatcacatcctgtaagggttaaataatacacaacatgtaaagcgaccaaaagcacctagcaactagtgctcaataatatattattaattattatatcatcattatagtcattatgcaatcattatgatcatataaattcctccaacctcttgttttctgttgtatctattcatttgtttcacaaattatc

SEQ ID NO: 78243 - DNA, 295 bp, Homo sapiens
tgggtgtaatatgatctaaaaagtattaataaaagtataactattttcattatattaagcaaagcatgcttattgacccatctatgaagagttgaggattcttagaaagccacttaaatgagatccctggatcttagacagatgacctctgctcagatttcagctcatctctctttagctctatggctttgagaaatcctttgatcttctcaatcctttgacttaatttacaaattatgtaaattatcaatgttgttcaagatatagtctgtggaacaccaaccccatgagatat

SEQ ID NO: 78244 - DNA, 905 bp, Homo sapiens
aacagtcaactgaggtaactcactaccttcagactagcctctgtcagttacatttgtaacttgaataacatgcttaaatttctatttcttgttctatcaagtttagacattttgtattgactccatatgtataagatacagaaattcttagctctgtattgctttttgcctcttttctaccatctattttcccacttctgttaactctagcattacttttactataatttaattttaattcactatgttctgcttatccagaagaaattcaagagggcttatacatatataaaacaggttctgagttgattaatatcatagtttaaaaaacttttaaggatgaattcttaagataaatgtgtggagaaggaataaaaagagtttattttcttagtgtacactcttatcctcctctgcgcaacttgacccttctaaattgtatcttgaagatacctctgatgtccttgggaacttttattttccaacctgtatacccagccatacctgaatttcattaaggtgtactgttttgcatatattcttgattctaggatgccttcaactgtaagacccattattgctttaaaataatgttattggttgggaggggattgcattaaatgattagtccaattaattaataaagtgagaaaacatttatagtttcttatatagaggggaaaataggcaaaaataaaaattaagtcactgttaattctgttgtccgcctttattttctttatccaaataaaactttttttttctttaaaaaaaaaaaaaagagctgggtacagtggcccacatctgtagtcccagctgctttggaggctgaggtcagaggatcccttgagcccaggagttacaagccaccctgggcaacatactgagaccctctctctttcttt

SEQ ID NO: 78245 - DNA, 992 bp, Homo sapiens
taacttcttggggaggggtaaggcaggtatcatctcttcttcttcatgacctcctactcaactgtggggaaggcatccatctggagccagaaccatgcacttcagtcctggttctgacacagttggctgtgcagtttcgggctcatcatttcatttctgtctgcctctgctccattttctgtgatctaacaattctgcttttgggctttgggtgaggattagatttaatttgtataaagtacctgatatataatataatagatgtttaataaatagcagcatttaaaattgttaccatcagcaaagggggagtacaggactaggagatccccaatgtcccatccactacaatacgcaaatacagtgtcatgctggaaaatacagaggcttggcctgcacggaaatatggggaaaggtctttgtgtttatgtgagagagaagatatccatgtctgtgtatgttccagatgatttttaggtcccatcgaattcccccttgctgcaaggaacagcaggagccagagcgtaaggtaaacgtgtctgttgcctgcctgagaaatgaagtcagagccgtgcctgagcccaccattcagggagcaaactgtgcacccaactttggttccgggtctttggtggtagagccagcatagggtagttgccagagctggcatgtgtacttttcctgttgcccaccaccgcctggagtacctggaccggatgcccacgttcctccccctgctgagcaggatgtgttaattgtcttttgcccggccacttccacctctcctctgcctcccctccatgcacaccacacagacaaagtaggaatatgctttttgatgttggctggttttagaagtttgcctcccacctttttttctctttccaaaggagaacaacctgaatacccacacacagtgttatctagctctgactttgaagaggaatttctccccttagggctctattcctggtatagcataatctaggaga

SEQ ID NO: 78246 - DNA, 434 bp, Homo sapiens
aaaggctggtgctgggcacggcagaccccaggaaggacagggcgagcctggctggaacccaagtgtcgaggatggccaagggcatcccgaagtagaatcacaggtgtaaaggggacctggggctcatctggcccctgtctagggcagtgtgtaagaaatgctcctgggtgccctgagggtctgactcaggaggcctgaggtcaggcagggaatctcagttttaacacccactccagggattcctgactggtctgcctgcatgcctcctgtgatgggagtctcactccctcccgaggggctctgtgccggcttctggctctcggctatgacgtgttcttagtcaggctgagctgtgacgtactggtctgtcccctcacccactcactggccccagcttattcaccccactcattcacatagtcatcaacccctgc

SEQ ID NO: 78247 - DNA, 341 bp, Homo sapiens
tggatgtggtgctgggtcttgtcaatgaccagctgggcctcgtggattctctgattcctctggggatattgggaagtgtccagtacaccttctccagcctcccgcttgtgaccggggaattcctggagctggacctcaacacgctggttggggaggctggaggaggactcatcgactacccattggggtggccagctgtgtctcccaagccgatgccagagctgcctcccatgggtgacaacaccaagtcccagctggccatgtctgccaacttcctgggctcagtgctgactctactgcagaagcagcatgctctagacctggatatcaccaatggcatg

SEQ ID NO: 78248 - DNA, 335 bp, Homo sapiens
ggtttgtttatttatttatttatttatttattttgacttaatggagcatgtccttgtagcttcctgaaaaaggtgagtttttttagtcttgcaagtttgaaaatggcattattctactttcacacattattgatactgtgaatgcatactaaattctagattgtcctcagaaaatttttcctttttttttttgagagggaatctcgctctatcccccaggctggagtgcaatggcgcattcttggctctctgcaaccctcgcctcccaggatcaagcgattctcctgcctcagcttccagtgtagctgggattacaggcgcatgccaccatgccc

SEQ ID NO: 78249 - DNA, 839 bp, Homo sapiens
ggatactgcattggttcttctccatcagctggcttagacatcaaacatcttaaatgatacactgttttaatatctaaaaatctgtcattctacttaattaacttagtcataaggacaaagccttagtatatttttgccacatacatgttatgtataaattttactgttgaataatacaagtattcattgctgactgaattcttaaaactttgggaatagaaaaaacacatttattaatggatgctaaagtgattcctgagaaaaataatgtgtatggttaatatggaaaacctttggtaatgtgatttgggtataagaatactaaaaccagagtacagggtgtgaatcatgtaccaggagggattttatttttaaatatctttattgaggtataattgaaatacaataaactgtacatatttaaagtacccaatctgataagttttgtcatatgcatacagccatgaaatcatcaccataagcaaggtaatgaacatattcatcactctcaaagtttcatagtacctctttgtgatcccttcttacttaatcctccttgccaccccaccatcaccagaccactgatctgctttctttatgatcagtttgctacaaatgaaatcacataatatgaaccttttttggtctagcttttgtcacttagcatagtaattttgtgatttgtctatattgttgcatttatgaataaatcatttatctgctgctgagtagaactgcattttatgaatatatcaatttgtttattcttttgatgatggacattaatagttctaggctattatgaataaagtttccatgaacatctatgtacaagtctt

SEQ ID NO: 78250 - DNA, 696 bp, Homo sapiens
gtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaa

SEQ ID NO: 78251 - DNA, 479 bp, Homo sapiens
agggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaagctcagataagtctgagagctactggcaaggttcccagtctaggcatttggcagtgacgcttatcttttcttctacagcttcttgcgccagagggcgtggccgagagggagcgggacgtcgctaggggtggtggcgccgttccttgctccgtctccg

SEQ ID NO: 78252 - DNA, 5015 bp, Homo sapiens
  misc_feature (1934)..(1934): n is a, c, g, or t
gtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggtgtgctatggcttgaaggaggccaccgccttttccccccacgaatggcactggaagacgagttcccccctgcactgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagangcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgaaat

SEQ ID NO: 78253 - DNA, 1279 bp, Homo sapiens
agggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaagctcagataagtctgagagctactggcaaggttcccagtctaggcatttggcagtgacgcttatcttttcttctacagcttcttggcttctttgcccataagaaaatccctgaggaagaaaaaagagaagagaagttggaccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgaaat

SEQ ID NO: 78254 - DNA, 461 bp, Homo sapiens
gagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaa

SEQ ID NO: 78255 - DNA, 388 bp, Homo sapiens
ccctggatctggaagagttggggagtggcaggggggcagtgtcttgtgaactgtccaaggactgggaacttgaggaatacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaaggtgaggattactctggagaaatgactagaggcgggagaagtt

SEQ ID NO: 78256 - DNA, 5173 bp, Homo sapiens
  misc_feature (2092)..(2092): n is a, c, g, or t
gggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcactgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagangcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgaaat

SEQ ID NO: 78257 - DNA, 4232 bp, Homo sapiens
  misc_feature (1934)..(1934): n is a, c, g, or t
gtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggtgtgctatggcttgaaggaggccaccgccttttccccccacgaatggcactggaagacgagttcccccctgcactgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagangcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggaccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgaaat

SEQ ID NO: 78258 - DNA, 378 bp, Homo sapiens
ggaggaaatacatccctagtgggggcgggtatgaaatactccctcttaactcatgcggtttctcactgacctctggttacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgt

SEQ ID NO: 78259 - DNA, 331 bp, Homo sapiens
tctcagttctgctaacagattggctttcagatgcttagtgacaccattgcttgaattaagaagccagagggagaatgttggggagagtgtgttattcctgagagttttaaatttagttctgcagccgggcacagtggttcacacctgcaatcccagcaccttgggaggctgaggcgggtggatcgcctgaggtcaggagtttgagaccagccttaacatggtgaaacgtcgtctctactaaaaataaaaaaattagctgggtgtggtggcaggcgcctgtaatcccagctactcgggaggctgaggcaggagaattgcttgaacctgggag

SEQ ID NO: 78260 - DNA, 343 bp, Homo sapiens
gttcaagcaattctcctgcctcagcctcccaagtagctgagactacaggcacctgccaccacgcccagctatgcttatgttttttaatgttcagattaatcatcataaaggcatttcatttttctctttaatgtacagagatatttttatttttaaagaaatgtatttcaaaaattatttttgaataggactattttaacaatataatacaccaggctgggcgcggtggctaacacctgtaatcccaacactttgggaggccaaggtgggtggatcgtttgagttcaggagttggagaccagcctgaccaaaatgatgaaaccccgtctctacttaaaaaaaa

SEQ ID NO: 78261 - DNA, 1035 bp, Homo sapiens
gttgttaattgtttttttttaagagactgggtcttgctctgttgtccaggctggagtgcgatggtgcagtcacggctcactgcagcctcaacctcctgggctcaagccatcctcccacctcggccttctgagtggctgggactacaggttcttgccaccacaccttcctgattttttatttttttgtagagacagcctgggcagcatagtgagactttgtctctaccagacataaaaagtaaataaaaataaaatgattaaacatgcacaactccacctcgagctggatctctccttaggtctaaagacacttgctgagaacctgatgtgtgcctggccttccaaggcacacctgtcactggcttggaactcagaccaatcaaaatgcctgtgctgctgacagctgagctctcttcctctggttctcctcctgtgtcctgggggtgtttttccagacctgctgtggggagaacctttgggctcagatgataaagatcctgaattagcagagtcctgtgccagctccagcccctgcctttgggtggaccggactaggctggggaaagaaagatgtctggctatgaaagggtggctggccaaggttgaggctcagcctgcccctgctcaggctccgagcagcaggctcagcagccacagttaggcacgtttgcacttccaaccatcacaggcaggcgggccaaccggcccatggtgtggtgactaacacctcattaatggtcataccccttctgtacctggcatgtgccctccattgtgtgcctccggcaaagagcccactatcaagttccccagtcagcagctacttggtagtcactgtggcatgtcggtcaccattaatatttgaaagatgcctgtgctctgcttcaggctgaggcaggcaccccttaccttcctgttatgtgaagatgcctgcaggaaaggtcacacctagggtgggtggactagtaatgctccctgttgttatttggccttcaaaattaaatttgtcttgggcccaagtggtttgcgatttct

SEQ ID NO: 78262 - DNA, 981 bp, Homo sapiens
gttgttaattgtttttttttaagagactgggtcttgctctgttgtccaggctggagtgcgatggtgcagtcacggctcactgcagcctcaacctcctgggctcaagccatcctcccacctcggccttctgagtggctgggactacaggttcttgccaccacaccttcctgattttttatttttttgtagagacagcctgggcagcatagtgagactttgtctctaccagacataaaaagtaaataaaaataaaatgattaaacatgcacaactccacctcgagctggatctctccttaggtctaaagacacttgctgagaacctgatgtgtgcctggccttccaaggcacacctgtcactggcttggaactcagaccaatctcctgggggtgtttttccagacctgctgtggggagaacctttgggctcagatgataaagatcctgaattagcagagtcctgtgccagctccagcccctgcctttgggtggaccggactaggctggggaaagaaagatgtctggctatgaaagggtggctggccaaggttgaggctcagcctgcccctgctcaggctccgagcagcaggctcagcagccacagttaggcacgtttgcacttccaaccatcacaggcaggcgggccaaccggcccatggtgtggtgactaacacctcattaatggtcataccccttctgtacctggcatgtgccctccattgtgtgcctccggcaaagagcccactatcaagttccccagtcagcagctacttggtagtcactgtggcatgtcggtcaccattaatatttgaaagatgcctgtgctctgcttcaggctgaggcaggcaccccttaccttcctgttatgtgaagatgcctgcaggaaaggtcacacctagggtgggtggactagtaatgctccctgttgttatttggccttcaaaattaaatttgtcttgggcccaagtggtttgcgatttct

SEQ ID NO: 78263 - DNA, 208 bp, Homo sapiens
tattattattactcctgttaccattttatggatgaagaaacggagacccagtggaagtaaataattttgctcaagatggccaaacaaaaagtggtagagcttttgcacttcttcctagctcccctgactcctggaacattgctggacagcacagtcagccctccatatctgtgggttctgtattcattaatttaaccaaccacagatc

SEQ ID NO: 78264 - DNA, 1771 bp, Homo sapiens
tccagtgctgaatgtttaatttcctatgaaaggctgcgagctagaggaggaagcaggaacacccagcgccgttcccgcccatcctcccgctccgccccgctccgcccgtgctgggctgtggcctccacaccaagcagccgccctgggccgccttccttcgtctgtgcgtgcagcgccgcctccttcagcttaggcccgacactccatgaactctcattttccaccttctccgtctccagcttccaagctgcacagggccaggccgaggtacgtgatggcgggcactgaattacagatcccgtctgtggccgccagcctctgtgtcctgccacctcctccgagaggacatcaccgccaccaggtggagcgagtctcctcctcggcgctccaaccacgtgctgtttattactctgtggggattcccataccgaggcctcttcagttcctggaacagtagcactaaaaggctcctgagtgcctctgttaatttgattgttctggttcgcactacaatgaccgggctggagagggggcgctcgtaatgaaacaggaactgctcctcgcgcccgctccagagtcctttacatctttggggagagggcatacggggagctacatttcattttcctgaagattttccacgcgaaagtgctggggagagagttgggcctgggaggctgcgccttcttcccgcgaatcccgaaaactgcgcggcaaaggcgggttccgcagaagtcgcgcgtgacccggggcgccgccctcctcggggcccattcggatctgccgcccgtcctctccagagcgccccctggcgccctctaggccatcttgattccaccgccgcagttgaaagaattaataaataaatcctagtctcgcgtctagaccggtccgtgagggtcccctgctcaccggacaccctgccgcaatctctgctgtcccattctggcctccctacggggacgggggccaccgtttgcacatcagcggcgtttgggacagcactgtgcaagatctgtgactcggctttcagaagcttctgccacaaggcttcaaaggaaaccttcaattttcacatttcctagggggaaaaaaaatctgagatttcttcttgtggcttgatgaacttagctttcgtcgctggaacaaaacccgaggaacagcgtcttcgccacccttgccaccttactgatgtttctcagggggcacatgcccatcgcaaccttatgaccaatcccatttttcagatgcagaaagaggctcagagaggttaagtgctacttgctcaaggccacagcagggagtggagctggattcgctcccaggcaactgaccccagcgtgcagtcgatgccttctcctagtcccactcaccgtgtaagacctggtatttacaaattagattctcgttgtgcttctccattggaagggcactaggggagctcattgtctaagactgccatccctaactgccttttaaaaagaaatctgggccgggcgcagtggttcatgcctgtaatcccagcactttgggaggccgaggcaggcagatcacgaggtcaagagatcgagaccgtcctggctaacacggtgaaaccccgtctctactaaaaatacaaaaaattagccgggcgtggtggcgggcgcctgtagtcccagctacttgggaggctgaggcaggagaatggcttgaacccaggaggctgaacttgcagtgagccgagatcgccccactgcactccagcctgggcgacagagcgagactctgtctc

SEQ ID NO: 78265 - DNA, 753 bp, Homo sapiens
gctcaggcacccgctgtggcccgtgaggggattgccctccctgcggggtggacagacacagggctcaaaggtgccccctccccaccctcggggagtggaccggaggggccgcctgggagggcagctgctccaggccattgtgtttgcgggagggggcggggtgggggccagagcccagaggggacctggaagtttggaactgagaaagtggcacaggagtagggcacgagggctttcgaaggatttgttttgggccttgggagtgctcgccgtcacggtgggcttagggggctcccgcctccagcccctcccccagtttaggaccctggcgggaggcttgaggctaacctcagagaaggggcaggaaggggtcaacccgcagccccacagggggagggaggatttctccaggagccctcctctaggcagggggccccttgcagcagtccctgagggcaggaaacgctgtgtgactgtaggcagagtgctcaacctctctgagcccaagtggctgtagttcatgccacaaacacctgagtgtccctgtgtgctggcttgggccgaccccagagagagcccatcaccttctttttggggtttggggcttggcctggaccatacagacaggggccaggagagaagttctcccctccctgtccccagacgtgttcctctgccctcatagactgggcctcccttcccacctcacatccccctcccaccttccccctgccagaccctgtaggccccata

SEQ ID NO: 78266 - DNA, 546 bp, Homo sapiens
ggatgcttaaactataatttgtagaagctgaaatggaaaatgggcctgaggtgtttcctggtaattagctgtcctgcctttccatggctggttgcttagaaatgacagtttgtgccactctgcgaaattccctgactgcaaagcacccactcactgcaggagaccacacgttgctttgtgaatcagtgggggttggggcagcagcatgttcttttttctcagctttgatttgttgttaattgagcaagctgtaattgtagacgtgaactgaaactgattatttaatcgtgggggattgaaataattgcctatgttgcaaataaggaattttatccttcctactttgtaaaagaaatgacatgcctaccacatgggaatagtctgtgctgagagaaaacatgcttgagcattttaattgggaatcagtttcattactttttttttgagatggagtttgtctcttgcccaggctatagtgcagtgagccgagattgcaccactgtactccagcccgggcaacagggcaagattccatctcaaaaaaat

SEQ ID NO: 78267 - DNA, 453 bp, Homo sapiens
cattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccatgcctgttcagtccgtcatggcgtttggtttatggtggccgatactaagagccactgaggtctgggttgtgtaagggttagctaccaccctataacctccctaccaggtaataaggagaccaagtctttgatcaaattctgattttttaactaaattttcattagaaagcaagcacaaaataaaatcaaaacaaccttt

SEQ ID NO: 78268 - DNA, 310 bp, Homo sapiens
  misc_feature (269)..(269): n is a, c, g, or t
  misc_feature (271)..(271): n is a, c, g, or t
cattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccacgcgtgctgcagatntngggagcccggaaacacctgggcccatgcctgtttcagtc

SEQ ID NO: 78269 - DNA, 655 bp, Homo sapiens
actgtgtgagggggttacagagatgagaggacacagttcttgtctttggctcactttaactgatgtaagtaggaccacaacataaggcaattgctgcacaatggaagggcgcaccatttattacaggtgaacaggaggctctgcaatagtggcctggaagggagtaacacagtgtctgagaagggcatgttgtttcctcataaataacctggaacatgattcatattgttggaattaagagttggataaagaagcatttatttaaaacgttgtcagggacatggagctcttcccaaggagccaaaataccatttagagttctagagatcctgcattcttgttttgactgcatgctctggacagtttgcagctcaggtaagaacaattccaacttccagatgagattagagcctagaaggggtttaatcttcaaatcatctgctaacttaaaaacaaaatttggaaacagtaatgattaacctgattaaagctgctctcaaggatcaaccagtaaaagaagtgatagcggtgtcaacaataccacataaagtagcaggatttgtatgtcagcagtcccatttttcaagatgccaagtctaaatctatttcctacccatatttaaatgaggagccagttttggaggaattttacttg

SEQ ID NO: 78270 - DNA, 836 bp, Homo sapiens
ccggcttgtgaggattacagctcccatgtccatagtctggcagatctctactatgtgttcagattatcttaaacgtgtagaggatgtataaagtagttccttgggccttttcagagatctcttttggttcaaaggggacacctaaagtattttaccaagttggataattattgaggttttcccaaactgatcagagccactgaggtgggtaatgttctagcactaaccccttacaggcctggagttgctgctagattgctactagccctattgggggaccccggtggtttctggacacgttggagtcatacgtggtgtccagcaacaacaccatatatgggaacacagagttggcaccaaacttgagatgtttgtaaagtaacttaagagagtaattcatgctcaatacagaaagtttgggaaacatgggaagtaccaaaagaaaaaacaaaaatcacctgtagtctcattatccaaaaataaacactactatattttggagtattcttttttaataaaacgatagcccaatgtacatacttatatgtggcttttttcttcccatttgttaatgtaagtattcttttatggtattttttttttgtttttacataactgcacagttagtctagcccttaaagtgccaagggcttatcacattcctagaactcactaacatatgttttcagattttgaccatgcttctacagtacacatttgaacaatgaggaacactaagggtaagagaccttattccttggattttccatgacccattgtttgagaaacctggctttgtttctacagtgagtatcagtggtcctattagagtgtct

SEQ ID NO: 78271 - DNA, 2361 bp, Homo sapiens
  misc_feature (821)..(821): n is a, c, g, or t
  misc_feature (888)..(888): n is a, c, g, or t
  misc_feature (924)..(924): n is a, c, g, or t
  misc_feature (978)..(978): n is a, c, g, or t
  misc_feature (1410)..(1410): n is a, c, g, or t
  misc_feature (1724)..(1724): n is a, c, g, or t
  misc_feature (1726)..(1726): n is a, c, g, or t
  misc_feature (1731)..(1731): n is a, c, g, or t
  misc_feature (1793)..(1793): n is a, c, g, or t
  misc_feature (1869)..(1869): n is a, c, g, or t
  misc_feature (2012)..(2012): n is a, c, g, or t
  misc_feature (2053)..(2053): n is a, c, g, or t
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggtgagagtctgcccggccggcgctgctcgctgcgttccccaggcctgggcgcccggtttttcgcggggagtcccgtcatccactgcggtagctcagccgctccgcctctcttagtccccgtgattcccgccgcccaataggatcgcgccctgtaggacgctcccttgagccttggcggtggcagccttttagtctgttccggtcttccccactggttctcttgccccttgatcctgaactcctcgtagtgtttccgcggttttcctgaactcctctagacgctctcgtgattcctcagggtcccctcagaacctgacgccacccaccagaccccttaggattcctgtgaggctccagtgacccacaacccccattgtctttccacgactcttcaaaacatcctatggcttccatgggcctccagagcaccccagacctcctgagggactcccttcatccctttgattacccagagaccttcagaacttccatggagcccccgtgatcccataggacccctcaatactcgtggggttcatgtgacctcatcggaactctcaggagcctagaatacatcaggacttccggtttgggttgggttttttttttgtttttttttttgagccagggtctcnctctgtcgcccaaactgaagtgcactggcgctatcacaccactgcagcctcaacctcctgggctcangccatcctctcacctcagccccccaagtaactgggnccagagacgcgcgccaccactctcagctaatatttgtactttttctagagacanggtttcacatgttggccaggctggtctcgaactcctggcctcaagtgatccacccacctcgacttcccaaagtgctgggattacaggcgtgagctactgcacccagccacatcaggacttcctgtaattacttatggcccctcacaataccctcacggggctcctatgatctctctagctctcagaatgtcccatagggttcccatgattgttcaggaacccctgaagtcctcgtgagggtcccatgatcccctgggggtcctcagaacctccctaggactcccatgacccctcagaggcccccagaaccctcgtggggttcctgcaaatgagtagggcacctcaaactttctgtcgtttccccaggcactctcagaattccttcacggggctctcatgatcccccagggtcccccagcacccaggcgaaangagcttaggcttctttgagggggagggcaggaggccagagcaatgatccaagtggaaggaactggatcagaaccctggcacagcctagaacttggggaggccaagacgggcagatcgcctgagctcaggaattcgagaccagcctgggcaacatagtgaaacctcgtctctactaaaatacaaaacattgggccaggcgtggtggctcagacttgtaatcccagcactttgggagtcctaggtgggcggatcacctgaggtcaggagttcgagaccagcctggccaacatggtgaaaccccatctctactaaantncaaanattacctgagcgtggtggtgtttgcctgtaatcctagctacttgggaggctgaggtgggagnattgcttgaatccaggaggcagaggttgcagtaagctgagattgcaccactgcactccagcctgggcaacggagcnagacgctgtctccaaaaaaaatacaaaaatggctgggcgcagtggttcacacctgtaatcccagcgctttgggaggccgaggcgggcggatcatgaggtcaggagatcgagaccagcctggccaagatggtgaaacccatctntactaaaaatacaaaaaattagctgggcgtggtggcaggcncctgtaatcccagctacttgggaggctggggcaggagaatcgcttgaacccaggaggtggagattgcagtgagccgagaccacgccactgcactccagcctgggcaacaagagcaaaactccatctcaaaaaaaaaaaaaaaaaaaaaaggaaacagaaaacaaaagattagccgaggatggcagcacacacctgtagtcccagctacccgggaggctgaggtgggaggatcacctgagcctgggaggtgcagtgatcataccactgaactccagcctgggtgacagaataagaccctgtcccccctg

SEQ ID NO: 78272 - DNA, 472 bp, Homo sapiens
aaaacccaaaagggggggggggttttccaacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctcctatatgacttttgtcaatttccatgatgtaaatgctcccaccgtgccggatttcaaggtacaggtgattaaacaactgcctgcg

SEQ ID NO: 78273 - DNA, 3086 bp, Homo sapiens
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctccta

SEQ ID NO: 78274 - DNA, 2933 bp, Homo sapiens
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggagggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctccta

SEQ ID NO: 78275 - DNA, 3164 bp, Homo sapiens
aaaaaaaaatgaaaaaatgttctagaactagagtggtgatggttacacaacactgtaaatgcacagaatgccactaaactgctgaactatacactttgaaatgctctattttaccacaaactttttttttaaagcaataggaggaaaagaattagctgatggggcagagggagacagacgtcccctcctagaggattctgggtaggggttgaactgccccagctcctcccgaacccctttccaaactgtctctacctcccccaggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctccta

SEQ ID NO: 78276 - DNA, 2959 bp, Homo sapiens
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctccta

SEQ ID NO: 78277 - DNA, 2630 bp, Homo sapiens
aattggctagagaggccgggggtaatcggcagaggagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctccta

SEQ ID NO: 78278 - DNA, 2627 bp, Homo sapiens
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaacccta

SEQ ID NO: 78279 - DNA, 2638 bp, Homo sapiens
gagaggcttcagagaccggtcgtactgtccaggctgcgtgccagacagactgtcatctcgaatatgcgactgccatgtctcagtgcactgcacccatggacgcgcaggctactgtcgatgctagaggtaggcccaatggtgacgctaatcgcgcctcttcctggtagcctcattctccgttccttgagagtgatgttggcgtgatttgacctggcatggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctccta

SEQ ID NO: 78280 - DNA, 3168 bp, Homo sapiens
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggctgcaccgtggtggccctcgtgcccccggcctccccggcgcccctcctcctggcccagctggcgggggagctgggccccttcccgggaatcctgaatgtcgtcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaaccctagctgtgcttctgcgagaagaaagggtgtagcaacttctggcagatatgaggcttttttcttttttttttttttttttgagacaacgtctggctctgtcacccaggctggagcgcagtggcacaatctcggcccactgcagcctcgacctctggggctcaagggatcctcatgcctcagcctcatatgtagctggggccacagacatgcaccaccacacctggctcgaggccattttagttctgaggttgagcagctcaggagccggctccagcacggtgctgtgtttgtgaaacagagaaaggggacccccgaggaccccagacagggccttaggactctcatatcttcttgtcttctccatctggtggctcttgctctctggttttctctaccttttcatggccccagaatccatatgcagtaaaggaactctctggaataaaattaaagtcctcctatatgacttttgtcaatttccatgatgtaaatgctcccaccgtgccggatttcaaggtacaggtgattaaacaactgcctgcg

SEQ ID NO: 78281 - DNA, 2221 bp, Homo sapiens
tttgggctggaaccggaggtgtcgctcttcggacctcaaggttccccttaacacagagcgccccgcagtcttcgcggaaagcgttcggggtaggcgatggctgcgacgcgtgcagggccccgcgcccgcgagatcttcacctcgctggagtacggaccggtgccggagagccacgcatgcgcactggcctggctggacacccaggaccggtgcttgggccactatgtgaatgggaagtggttaaagcctgaacacagaaattcagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggagtaattggcctcatcctgccacccacattctccttccttgagatgatgtggaggatttgccctgccctggctgtgggcggcttcggagtggccgagggctggatggggccgtggacatgggggcccggggggctgccgcatgtgacctggtccagcgctttgtgcgtgaggcccagagccagggtgcacaggtgttccaggctggtgatgtgccttcggaacgcccattctatcccccaaccttggtctccaacctgcccccagcctccccatgtgcccaggtggaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgtgccctcaaccctgccggctgggcctgaaatagggcccagcccagcacccccctatgggctcttcgttgggggccgtttccaggctcctggggcccgaagctccaggcccatccgggattcgtctggcaatctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggctcccgccctggcctacggcaacactgtggtcatggtgcccagtgcggcctgtcctctgctggccctggaggtctgccaggacatggccaccgtgttcccagcaggcctggccaacgtggtgacaggagaccgggaccatctgacccgctgcctggccttgcaccaagacgtccaggccatgtggtatttcggatcagcccagggttcccagtttgtcgagtgggcctcggcaggaaacctcaaaccggtgtgggcgagcaggggctgcccgcgggcctgggaccaggaggccgagggggcaggcccagagctggggctgcgagtggcgcggaccaaggccctgtggctgcctatgggggactgatgcctgagcgccacctactgcattttggacacctcacaccaaggggagatgcaccccacagacacctgggactttccccttctggttcctgtgtctcccaataaactctctgaccaacccta

SEQ ID NO: 78282 - DNA, 1617 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78283 - DNA, 1178 bp, Homo sapiens
  misc_feature (1091)..(1091): n is a, c, g, or t
  misc_feature (1123)..(1123): n is a, c, g, or t
  misc_feature (1127)..(1128): n is a, c, g, or t
  misc_feature (1131)..(1131): n is a, c, g, or t
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggaggtgccccttggcttgggactccttggtggggcccactgcggnggcccctctaacaggtggtaatccccaggganaccnnggngccgggggttgaaccctcgggggacaccgaaactccgcgagttccac

SEQ ID NO: 78284 - DNA, 1250 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78285 - DNA, 670 bp, Homo sapiens
actccaggaggaagtcgggagtggctgggcagcatgcaggcagcgtccagtaggcggcagtggcaggaaggccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78286 - DNA, 975 bp, Homo sapiens
agcagagaggcggggttagtggacgagggaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgaggactggagggcgcgtccttctgcatgcgctatgaagtgcctgatgtgctgaggatgctggtagcctttgttcctttggtcaagcctctacttggggggtccggacaccgttttccaggggggcactgtgggtgggccgggtatctcatgggggggggccccggggtaatttggtcaaaaaaacgggttgggggggggggggtcccctaaggagctgttaggaa

SEQ ID NO: 78287 - DNA, 594 bp, Homo sapiens
atcagcctgcttcttcccctctgcggctgatgtcaacagcgtggggctctgtccctcaccccaaggagagggagtgtgccagatcccaggccaccaagcggggcagctccagcctgggcgatcgtcccagcagctgagagggaagctttaagcagaccagtgggtaggagaggagggagcatgcggcaggtggggcagcacacaaaggagagttcccagaaggccaaggtgtggtcatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78288 - DNA, 1335 bp, Homo sapiens
ttttttttccccccccccttttttttttttggggttggggcggggggtggtttttgtaggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactgaaaaaaaaaaaaaaaaaaaaaaaaaaaaaaaaaagaaaaaaaaaaaaaaaaaaaaaaaaaaaaaaaaaaggggggggggcggcgccaaaaaccctccccgtgggggccccaagagagccgcgcccccgcgatgtatgagagagagggggcccccaagaggggggttataaaataacagcagcagcgcggcggcggccggctttttataacaccacgaacgtcgagtagtgcgggagagaaaaacgcgctgcggtccggcggggtcactcttgttggaggaaggaagccgcccccttctgtatcgccgggggggggcggacgaaaaagtgttgcgggcgaccacaccaccctcctcgagcggagtaatatattataagagatctgctggagggactaaataataaaacagttttagagagggagatgatagagggtggtagacaaaaaaaggaggggagtaatagattgggggcgagctggtggcgaggatgaatagatatgtctgtggtcgactcggcagaggagaagtatatatagtatatgtgagagagaaaaataattttatctacacgcggagggggctgctttatattagatataaaaaaaacacgggggggacgagcacagcgccgcgcgagggaccaaggcgcacgagacggcggcgcgagcgggacagcagcagcaacagatgagaagagacgcgggaggaatagcgcagacggagtgggggccgaggaggcgagcgagccaggaggagcagagggagggacggcgaggcaggagcgcggggggcggcatggagcggtgagacgccgaggagacgtatagaggcggcgagcagaggaaaggacaccgacagcagcagaacacgacgtacagatcgcgcagagacgcgc

SEQ ID NO: 78289 - DNA, 2704 bp, Homo sapiens
  misc_feature (1690)..(1690): n is a, c, g, or t
  misc_feature (1847)..(1847): n is a, c, g, or t
  misc_feature (1850)..(1850): n is a, c, g, or t
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtggacgcacatttctctttcacctgggtttccctgggtctcatggacagctccaacttgatttgggtnggggattttcttccagatctttttttcttttgttttgagacagggtctctgtcgcccaggctggagtgcagtgacgcaatccctgctcactgcagcctctgcttccccagttgaagtgattctcccccgtcagcctcccaagtagccgatattacanggncgtgtaccaccacacctggctaatttttgtatttttagtagagacgagttttcaccatgttggccaggctggtctcgaactcctggcctcaagtgatccacctgcctcggcctcccaaagtgctgggattacaggcgtgaggcactgcacctggcccccagatctttctgtagtaatactgatctcttaaccacaacccttgaactgagaaatgatcatggggtgtgtcctaagcagaacatcatctgccttcctgtctgggccagtgtcaggacaaaaatgggtgtacagaggagcccggggcccagttggaaggaagaggcactgtcctgcccgctgggcctgtgaggtcaggttttgtttgtgaaacaaactcttggtaattcaggagtcaagacatctctcagctgtgcctcagagatgggctgttggcagctcacttgggggcaagcatcgctggggtaaggtgtgtcctgtgcaggcagggtcaccactcccagggcctccccagcctccctctccccttcgctagtgatgtgtcccaagccaaagccatcgggtgaggctgggagcagtgccctgttagttcgtactggggatttttaaacaatcgggacttgccgatgacagctccctctgtcattgctcaaaagaagaagccagaagttgctttagggccttgacctcttccagagatgggccttatctctcgaggggtgggctggacggccaaggccgtgtcccaggaaggctccagaggtgctgaccctggaggaaggtagaaacctggtcttacctatggtacccctattcagtgcaagaaaggggcattcaccgacaactcccaggtaccc

SEQ ID NO: 78290 - DNA, 2401 bp, Homo sapiens
  misc_feature (1690)..(1690): n is a, c, g, or t
  misc_feature (1847)..(1847): n is a, c, g, or t
  misc_feature (1850)..(1850): n is a, c, g, or t
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtggacgcacatttctctttcacctgggtttccctgggtctcatggacagctccaacttgatttgggtnggggattttcttccagatctttttttcttttgttttgagacagggtctctgtcgcccaggctggagtgcagtgacgcaatccctgctcactgcagcctctgcttccccagttgaagtgattctcccccgtcagcctcccaagtagccgatattacanggncgtgtaccaccacacctggctaatttttgtatttttagtagagacgagttttcaccatgttggccaggctggtctcgaactcctggcctcaagtgatccacctgcctcggcctcccaaagtgctgggattacaggcgtgaggcactgcacctggcccccagatctttctgtagtaatactgatctcttaaccacaacccttgaactgagaaatgatcatggggtgtgtcctaagcagaacatcatctgccttcctgtctgggccagtgtcaggacaaaaatgggtgtacagaggagcccggggcccagttggaaggaagaggcactgtcctgcccgctgggcctgtgaggtcaggttttgtttgtgaaacaaactcttggtaattcaggagtcaagacatctctcagctgtgcctcagagatgggctgttggcagctcacttgggggcaagcatcgctggggtaaggtgtgtcctgtgcaggcagggtcaccactcccagggcctccccagggtttcctctacatcaacgtataacggttttcgatgaaag

SEQ ID NO: 78291 - DNA, 2513 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactgaaaaaaaaaaaaaaaaaaaaaaaaaaaaaaaaaagaaaaaaaaaaaaaaaaaaaaaaaaaaaaaaaaaaggggggggggcggcgccaaaaaccctccccgtgggggccccaagagagccgcgcccccgcgatgtatgagagagagggggcccccaagaggggggttataaaataacagcagcagcgcggcggcggccggctttttataacaccacgaacgtcgagtagtgcgggagagaaaaacgcgctgcggtccggcggggtcactcttgttggaggaaggaagccgcccccttctgtatcgccgggggggggcggacgaaaaagtgttgcgggcgaccacaccaccctcctcgagcggagtaatatattataagagatctgctggagggactaaataataaaacagttttagagagggagatgatagagggtggtagacaaaaaaaggaggggagtaatagattgggggcgagctggtggcgaggatgaatagatatgtctgtggtcgactcggcagaggagaagtatatatagtatatgtgagagagaaaaataattttatctacacgcggagggggctgctttatattagatataaaaaaaacacgggggggacgagcacagcgccgcgcgagggaccaaggcgcacgagacggcggcgcgagcgggacagcagcagcaacagatgagaagagacgcgggaggaatagcgcagacggagtgggggccgaggaggcgagcgagccaggaggagcagagggagggacggcgaggcaggagcgcggggggcggcatggagcggtgagacgccgaggagacgtatagaggcggcgagcagaggaaaggacaccgacagcagcagaacacgacgtacagatcgcgcagagacgcgc

SEQ ID NO: 78292 - DNA, 1908 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactgaaaggaaaacacagacaaaaagaaaaaacaagaaaaaacaaagaagagaacaaacaaaacacgacgcgggaggagccctactagccgggcggggcgggcgaaaaaaacgacggcgtactgaaaaaagggcggcgaccgcgggggtgccacaagcgagggggtccgtccagacccccaacttgttgggcgacccacaacagggggcggaaaacacggtgcaggggccacacccattcaaaggcaggcggcgtcaacagcggaaaaagcccccgtggaaccccgcctaataga

SEQ ID NO: 78293 - DNA, 1600 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggacacgggttccaattaaaccccggggggtagctttattaatac

SEQ ID NO: 78294 - DNA, 1561 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcgaggggatggagttgcccacaagggggcctgggtgcatcaaataggcagccggtgagtcaagcagcctcggggccagtggggctggagagatgccagacccaggggtctatgtgtggaccctaggtatttggaactccc

SEQ ID NO: 78295 - DNA, 1539 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78296 - DNA, 1422 bp, Homo sapiens
agcagagaggcggggttagtggacgagggaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78297 - DNA, 1641 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccgaactcgaagtaggattatagcaaggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78298 - DNA, 1716 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtagctccacctgccttccctgcaggccggcggggtgggggtatggctctgcctccttcctgtcctggcccttcacccatcccctgtccctgcggccaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78299 - DNA, 1622 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccgttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtagctccacctgccttccctgcaggccggcggggtgggggtatggctctgcctccttcctgtcctggcccttcacccatcccctgtccctgcggccaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78300 - DNA, 1455 bp, Homo sapiens
gccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78301 - DNA, 715 bp, Homo sapiens
tcaagccggcctgccactaacctctctgtacactacgcactcacactctactcacgcaagctccactcacggctccgcaccgcgatacccagagcaccactagtagcccctgtgcgcacacttctgtgacccatatcactggacgggggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactg

SEQ ID NO: 78302 - DNA, 427 bp, Homo sapiens
tttctctgtttagggagggaagagggaatttaaaatgcccaaaatactgtttcacacattctttccagaactcgaagtaggattatagcaaggtaataacgaaacaatagttgtaaagtatgtttttttgtttgtttgttgtttgtttttgggacagggtctctctctgtcacccaggctggagtgcagtggctcaatcatagcttactgttacgtgaccccaaacccttgggctcaagtgatcgtcccacctcagccccctgagcaggtgggactacaggcgcacaccaccacacccagttaatttttacatttttttcacacagtgtctcgctgtgttacccaggctggtctcgaactcctgagttcaagtgatcctcccgtcttggcctccccaaagattacgggcatgagctgctgtgtctgg

SEQ ID NO: 78303 - DNA, 1379 bp, Homo sapiens
agataaccagaaccgcaaatgcaggcgggggtgtcccagagtcggctccgcctgcaccccagggcgctggggccgggcatggggcggggggtgatataagaggacggcccagcagagggctgaagattttggagcccagctgtgtgccagcccaagtcggaacttggatcacatcagatcctctcgagctccagcaggagaggcccttcctcgcctggcagcccctgagcggctcagcagggcaccatggcaagatcccttctcctgcccctgcagatcctactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaatgtacaccgagacccttattcaccacctttgacccagtaactctaatcttaggaagaacctactggaacaaaaaaaatccaaaatgtagaacaag

SEQ ID NO: 78304 - DNA, 1235 bp, Homo sapiens
ggagagggtgatgctggctccaagcctgactctgctctcgagagctccagcaggagaggcccttcctcgcctggcagcccctgagcggctcagcagggcaccatggcaagatcccttctcctgcccctgcagatcctactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaatgtacaccgagacccttattcaccacctttgacccagtaactctaatcttaggaagaacctactggaacaaaaaaaatccaaaatgtagaacaag

SEQ ID NO: 78305 - DNA, 525 bp, Homo sapiens
gacctagtgtgtccctagcactagctctcccattagtccccagagacaatgagtctcttctcattggctatggtggaagtccataatctgcaagacaaagaccgataactgaggaatgtatgagaatgagttgggctttgatctgaagccaaagttaatctccggctctattccctctagggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccct

SEQ ID NO: 78306 - DNA, 581 bp, Homo sapiens
ctcgctctagaggctcccccgatcggtctgttaaccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaatgtacaccgagacccttattcaccacctttgacccagtaactctaatcttaggaagaacctactggaacaaaaaaaatccaaaatgtagaacaag

SEQ ID NO: 78307 - DNA, 205 bp, Homo sapiens
gcaacaaacttccaaagtatgccacaaacccctcaaacacaaccaaccttactgctgagaagttcagagtcaaacctgaatctcacctctgcaaagagcacaggactccatggcaaacgttgtatatacgcaagtcatccctggcaccaccttgatttactgcaccaggctttcttcattgtgatgatgttctctctcttttcta

SEQ ID NO: 78308 - DNA, 205 bp, Homo sapiens
tcacaaaaatcacaacaacctccccttagaccataaaaaccaaaagtctgactgctgagaagttcagagtcaaacctgaatctcacctctgcaaagagcacaggactccatggcaaacgttgtatatacgcaagtcatccctggcaccaccttgatttactgcaccaggctttcttcattgtgatgatgttctctctcttttcta

SEQ ID NO: 78309 - DNA, 669 bp, Homo sapiens
taaggtcttgtaagctgtctctggctttttcttgggctgtgtggaggaatccactctgtatggagaatgaagctgacgggcagagagaaatagagatccaagaaccttcttgtagggtctggattgggacccttttctggtaacatcttcctggtgaccatgaagggacaatactgaagagacccctgaccctaaggaaatagactgcagcaccaatgggccaactttggggcgatcatcttgcccagaaacatcatgttgaaactcttggtcagaggttggatgaaagctgacagggtccatccaggagcaagtttgagccttgccagttccattttgggtgctgagtggagtggcgactatagcaaacctgtgatctctggctgctgctcagaagaaacaagagggagggatgaataatgtaaaactctggatcaatattctaattctgagcctctattggaatcagctagcaaccacatatcagcttggtttcaacagtttcccagttcatgctgctgagaagttcagagtcaaacctgaatctcacctctgcaaagagcacaggactccatggcaaacgttgtatatacgcaagtcatccctggcaccaccttgatttactgcaccaggctttcttcattgtgatgatgttctctctcttttcta

SEQ ID NO: 78310 - DNA, 642 bp, Homo sapiens
attcccttactttcttaataaactcgctttcactttatggattcaactgtaattctttcttgtgtgagatccaagaaccttcttgtagggtctggattgggacccttttctggtaacatcttcctggtgaccatgaagggacaatactgaagagacccctgaccctaaggaaatagactgcagcaccaatgggccaactttggggcgatcatcttgcccagaaacatcatgttgaaactcttggtcagaggttggatgaaagctgacagggtccatccaggagcaagtttgagccttgccagttccattttgggtgctgagtggagtggcgactatagcaaacctgtgatctctggctgctgctcagaagaaacaagagggagggatgaataatgtaaaactctggatcaatattctaattctgagcctctattggaatcagctagcaaccacatatcagcttggtttcaacagtttcccagttcatgctgctgagaagttcagagtcaaacctgaatctcacctctgcaaagagcacaggactccatggcaaacgttgtatatacgcaagtcatccctggcaccaccttgatttactgcaccaggctttcttcattgtgatgatgttctctctcttttcta

SEQ ID NO: 78311 - DNA, 499 bp, Homo sapiens
attcccttactttcttaataaactcgctttcactttatggattcaactgtaattctttcttgtgtgagatccaagaaccttcttgtagggtctggattgggacccttttctggtaacatcttcctggtgaccatgaagggacaatactgaagagacccctgaccctaaggaaatagactgcagcaccaatgggccaactttggtgatctctggctgctgctcagaagaaacaagagggagggatgaataatgtaaaactctggatcaatattctaattctgagcctctattggaatcagctagcaaccacatatcagcttggtttcaacagtttcccagttcatgctgctgagaagttcagagtcaaacctgaatctcacctctgcaaagagcacaggactccatggcaaacgttgtatatacgcaagtcatccctggcaccaccttgatttactgcaccaggctttcttcattgtgatgatgttctctctcttttcta

SEQ ID NO: 78312 - DNA, 551 bp, Homo sapiens
cagtgaagtaaaggcttctcttgcaaaatctgagtgccgatctgtgatgggaaaaataacttccagataaagcaaaagttgatgtggacaccagtacccagtaaattactgtgaaaaaaaggcaacttctcttggtccagtttacctttagataaatgttttaagggtaaaaatatgtgtatttcaagatatgtcttatgtaaacttttttaagttatgaaaatcatccatattgaaaaatagaatgttttctattttgaaactgttttgcattgtcagttacttaagcagccattttacattttggtttttgagaacataatagggacctgtatactccttgtggggccgcattttaagactcctgacagctcatcctgcaaaattaaaatccaaaatctaagtcgcaaaattctcttttctccttcctcagttatttacttagagtgtagaacagacatcctcttagagttttttgtaactatcagttatcgttaacatcatatttttattctaaatccttccatagaaacactgcttgttggaaaaaa

SEQ ID NO: 78313 - DNA, 1376 bp, Homo sapiens
gcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaattcctgaaaccacattctggataagaactatcctatgagaatgagcaaaagtaggaaattcagtcgagcggccgcgaatttagtagt

SEQ ID NO: 78314 - DNA, 2896 bp, Homo sapiens
gcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtctttttttaaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtccaaaaaaaaaaaaaaaaaagagaaaaagaacgaaaaaaaacaaaaacaaaagagacagaacacaagaaaaacaaacaaaaaaaagaggggggcgcgactgaaagaataccccccaggaggggagccgttgtacgatcagacacaggtttgtaaagagaggggcacaatagagagatggaaaaaaaaacacacgggggcggggtaataacactgtcggagagagacaactagcggggagcactgaagaagagcccaacatatggggcgaggaagagtagggagaccccaacaacaggatatagggacacgagggaaaaaacaagaggtggtatatgataacaaggaaatttgtgtgggagaaaaatgtgcaggtatttgttagaatttaggccgacagtaaatatgggataaagacacaagtagataataagaacaaagagaaaatgagagagaacaaaagtaggagaagaaagagcaaaagagaagaaaaaaagaaaagataatgatgatgatgaataaagacgtc

SEQ ID NO: 78315 - DNA, 1928 bp, Homo sapiens
  misc_feature (521)..(521): n is a, c, g, or t
  misc_feature (1923)..(1923): n is a, c, g, or t
ttcttagaagtggaaatgtgtgtagcaataggaacggttcctaaggccaagaataaatggattgcggttgtgggtcttttggtagcactaagctttctgttgcagtgtgtgagaggacccggggagagcccaatcttcgaagggacagatgaggggtatgacctggggagcccacaaccgcctttgcttttcgcagatgctgggaacgcagctctgctgccggcggggtggacagaccctcccccagccattgctgcccacctgctgcgtcagggcctcccctgcccagctcagtcttggccaagcccagtctggaggagcatgcaccgcctgtgagcggtctgggcagcgcttcccaggttgcccatcagatgagcccgtcccaggtgtcgaggaggagatctcctgagcggcagtctcggaaatccttccccgtggaaggacacgttaacctctcgtgcttcccatttcaaaattctgtttccaacacgatttgatgaaagattgaaatatctgaaaantcatttcgagcacagggtctggcattgtgattctcaggtgaactgggcgtatggttgaggtaggacttcaaaaaagtgttcgaacgtcatttgcagcatttaaactgagctccaaatgacgttcaaacacccctctcgggtagagttttcatggtggaacggttgcgcccaccaaacagaagcttatgtttttggcacagaaggcctgggccattttcatggacacctggctggacctcggtggaagtgaactccgtaggttgttgcgttcactgcagcacctcacatgataccgtcccctctcatggaacggagcctcccccatgcagcccccactcaaatggagttttaaaggctgggttcaggttacgggggcgtttctcaccgtctgaatgcggaggacagagacgagctccagggagcgtgggcgggtgacggcgctgagatgcgtgatgtctcggaaacgtcctcgcatccctcagcgcgggcgctgactgccgcggcccttgcctgtcttccaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggtaatgcagccgcggctggcagccttcgcaggaccctttgtggtggtcccggccggcaagtccccaaggcagcgccattggcctgggcctggggcttgaggaggatgattctctgcttctgcctctcgctgccttgtccctttaaatcagcatgagctgggcaggtggctcatgcttataatcccagtgctttgggaggccaaagcgggtggattacttgaggtccggagttcgaggtcagcctggccaacatactgaaaccccgtctctactgaaaatacaaaaattagccaggcatgatgatgcgctcctgtagtcccagctactcaggaggctgagggaggagaatcgcttgaagcctggaggcagaggttgcagtgagctagactgcgccactgcactccagcctgggcgacagagcaaaacccngtctc

SEQ ID NO: 78316 - DNA, 2929 bp, Homo sapiens
cggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggggctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagaccccaagtttttctttgtttgtttaaacatggaattcagacttcattgtacacctgagacagacacaaaagggatcatgtatttttgaggattttacctgttgacgtctgatgaccggccgtaggtccagggttcccgctgggtttaatcccctcgaagagtaaacctgccgctctgtctgataacttcaagtaagagcagcggcttcctgggttggcgttcgcggtggaaggttcctaggatgaaaggtgagcctggatccgccggccgcagacatcgcgctgctggggacgattggggccgctgctctgcagaccagaccttcccgaattatccgtggctccgatgtcccggtgctgacggccacatggggacctaacagtgccaaacgccatctgctccagctgctttttcacccagttgcagagtcctcaccactcccac

SEQ ID NO: 78317 - DNA, 1892 bp, Homo sapiens
  misc_feature (1883)..(1883): n is a, c, g, or t
cggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggtccacgacaggtagcgggaagctaagcctacaggccttgaggtcctgggactcagcgagtcatccggccgcgggggtcccccgcggtgccaggtgggcccaggagccacacaacgctgtgatgagcgacacacccccacattgtcaacggatgctcccttcaagaagaccgaaaagcccggggtgaacaccggggtacacccgggagtcagcagccgcgaggcaggacacttacggaggacagacgacacgcgaacactcacacgatgtcactanacgatatga

SEQ ID NO: 78318 - DNA, 1141 bp, Homo sapiens
cggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggtaaagttctctgagcgcccgtcctccagctgttaggaaagctgagctgccctggagtttagagatacgtggcgcagtcagccctccggatctgtgggctcaggctcagtgtacgggcatgcaactgatcacaggtcaaaaatattccaaaaaaaagaaggccggcgcggtggctca

SEQ ID NO: 78319 - DNA, 1743 bp, Homo sapiens
gagcaacaaaattctgtctcaaaaaataaataagtaagtaaaatattgttctaaaaccctagtaattttcttcccaaacctatttcacccatgggattttcctctagcaaacctattttttcccagtgccgacctcactttccccacttgtccgacctgctgcccaggcgtcgaggaaatcgattgtctcgttggccgagtgtggtgctgacttggttcctgtcccgcaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggggctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagaccccaagtttttctttgtttgtttaaacatggaattcagacttcattgtacacctgagacagacacaaaagggatcatgtatttttgaggattttacctgttgacgtctgatgaccggccgtaggtccagggttcccgctgggtttaatcccctcgaagagtaaacctgccgctctgtctgataacttcaagtaagagcagcggcttcctgggttggcgttcgcggtggaaggttcctaggatgaaaggtgagcctggatccgccggccgcagacatcgcgctgctggggacgattggggccgctgctctgcagaccagaccttcccgaattatccgtggctccgatgtcccggtgctgacggccacatggggacctaacagtgccaaacgccatctgctccagctgctttttcacccagttgcagagtcctcaccactcccac

SEQ ID NO: 78320 - DNA, 1057 bp, Homo sapiens
cggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggtctgagcccacctggcgccgtggtgcacctggtgacccaggatcgggccatagtgacccggcgcgggcggcacagacagcccagggcctgcgggcgtgtgctcgaggtggtctcagcccacagggaatggagccgcagctggcggtagagccgtcggccctttctcgttttcgtgcccaaatcatccccgttggtcatttgctggtgacaggggtggcgccgtcaccgagggtaccctcccgccacgctccttgttcatctgccgctggcagcccggcgtcaaagccttcatacagcccttgagcaggatggcgttctccttataactttgtcttagttcatttttgtccaatagctgttttcaaattgatttctggaagaggtgagaaatttcagaattaaattataataaaaccgaagttttccttcccat

SEQ ID NO: 78321 - DNA, 436 bp, Homo sapiens
ctggcacaacctgcaatgctggtggtgagggtgcctgtggtcatcatcttcatagtttgggtacttactgtgtgtcaggtactgtgctaagtgctagtatttttcaacaggacggaagccttcccagtcctgcagccacctgcagactctcacaagcacggtgctcccgggagaagaccttgctaccccaggcccaaggcagtcgagagaaaacgggaagccctgaaggtttttcaccccgggggtgagagtgtatgatcgaagatatatttgagggtaattgtacagatagtcccaacttagcattgttcaactttatgatggtatgaaagtgatgacattcagtagaaattgtacttcaagtgccaatacaatcagtttttcacttttggtgcagtattcaataaattacatgagatattcaacactttacttt

SEQ ID NO: 78322 - DNA, 755 bp, Homo sapiens
ggggtcggtggagccgggatgtcaagttcaccttccagccgccgcgggctccctcggcctggggcgcctctaatggaccccggggtcggcctgagccctcccggagcgcccggcggctggtttccattagggcagttccggcgccgacttcgctggggacggggaaggtgacccccctactcggatcccccaggtcctaaagccaacacaagccatcagccccatgctcagctcccagcaggcagagcgttcagaagcgccagcgccatcatcttgggagcctgcagtccacacaccgctgaccttacctacttcctctttccaggtcgtagattacagactctcctctgggaaattgcccccagatctaacaggagtacaagaagctgggtagattggaaaacagcaccgaattcccctggaactgaggacggaagccttcccagtcctgcagccacctgcagactctcacaagcacggtgctcccgggagaagaccttgctaccccaggcccaaggcagtcgagagaaaacgggaagccctgaaggtttttcaccccgggggtgagagtgtatgatcgaagatatatttgagggtaattgtacagatagtcccaacttagcattgttcaactttatgatggtatgaaagtgatgacattcagtagaaattgtacttcaagtgccaatacaatcagtttttcacttttggtgcagtattcaataaattacatgagatattcaacactttacttt

SEQ ID NO: 78323 - DNA, 651 bp, Homo sapiens
gacaagcgctcttccgctagtgtgccgggatgagcgggggctggacttctagaaaggggtctgcgggcgcaggagctggggtccgcggtctggggccgccaacacaagccatcagccccatgctcagctcccagcaggcagagcgttcagaagcgccagcgccatcatcttgggagcctgcagtccacacaccgctgaccttacctacttcctctttccaggtcgtagattacagactctcctctgggaaattgcccccagatctaacaggagtacaagaagctgggtagattggaaaacagcaccgaattcccctggaactgaggacggaagccttcccagtcctgcagccacctgcagactctcacaagcacggtgctcccgggagaagaccttgctaccccaggcccaaggcagtcgagagaaaacgggaagccctgaaggtttttcaccccgggggtgagagtgtatgatcgaagatatatttgagggtaattgtacagatagtcccaacttagcattgttcaactttatgatggtatgaaagtgatgacattcagtagaaattgtacttcaagtgccaatacaatcagtttttcacttttggtgcagtattcaataaattacatgagatattcaacactttacttt

SEQ ID NO: 78324 - DNA, 331 bp, Homo sapiens
aaaaaaccagtcttcataagtatttgctgctacctttccctgtcataagaaaaaggatagccagacatggtgggacgccactatgatcccagctccttggaaggctaaggcacaagaatcgcttgaacctgggaggtggaggttgcagtgagctgagatcatgccactgcactccagcctggtgacagagcaagagcctgtctcaaaaaaaaaaaagaaaagaaaagaaaaagggatatcttttcctcctcccagaagtttgttttaaatttgagcatttatcatgcacctgatgtaaacctaatagtactcttgatactctagtggcttg

SEQ ID NO: 78325 - DNA, 206 bp, Homo sapiens
ggaaatactttttctggaatttctaagacttttttttttctttctctctggagaaatatgggaaatcagcctctcctcttcctgatgctgtgtgaggaaatgtgtaatccgattattactggcagccattccacaaccaaaagggagcccaacttaaaatgaaaccaatcctgtggttgactgaacagaatgtcacgtaaattaaa

SEQ ID NO: 78326 - DNA, 418 bp, Homo sapiens
gacatagcctactgtttattgggcaggagtttattaaactgtttattaaactaagaaaaattgaaaactcaggaaaagtcctgaaaatgaccaaatggcatcaaacttagagcattctggccatctaagctcccaatcattccaaaaaactgtacaacactggaaatgacaattttttttgtttgggaaccagtatggattccagaatagataaatccttctgacacaatttgcataccacatcctctcctggacacttcacctgccacttagagttgatgtcttaatgggtgggattcctcataatggaaccatacctggattttcctgggtcaagtagctatcacatcactgagcagcataaacaagtatcaattcctgtggaaagaggctggtttgggccaggcactgtagctca

SEQ ID NO: 78327 - DNA, 177 bp, Homo sapiens
catatttcatagaagtgtttctaaatatatctattaggactcacaggacaagaagataatgaagtgcttggctcaggaaagtggccaagtacatgatgggtagagaattcaaaggagttgggggagatgagttaacagcatgtgcacatcaagtgcttaattcatcctgaacaagga

SEQ ID NO: 78328 - DNA, 177 bp, Homo sapiens
cactcttgatctgagcagctgttggatgctgctgttttcaacctgagaagtttttaaaactattttcctagtcttaactctattgttatatctctcttaaatatcttcttaattcatgaaggccagactatagtccaggacccataaaagtttcccatgtatttcagtctggaacag

SEQ ID NO: 78329 - DNA, 498 bp, Homo sapiens
tcaaagagatatgttctgagtcactactcctcatcccaactattccattcccattccccttttctttctactgtgttcccacttacctccaaagataaccaaactcattcgtttttagtttatccttcctgtatttttatgtgatggatcatcagatacatgtatattttcttatatccccttctttcttactacagataatttttttgatactctgctttatttcacttaataatatagttgtggccgggtgtagtggctcacacctgtaatcccagcactttgggaggccgaggcaggcagatcatgaggtcaagagattaagaccatcctggccaacatggtgaaaccctgtctctactaaaaatacaaaaattagctgggcatggtggcgcacacctgtagtcctagctacttgggaggctgagacaggagaatagcttgaacctggaaggcggaggttgcattgagccaagatagcaccactggactccagcc

SEQ ID NO: 78330 - DNA, 483 bp, Homo sapiens
acggctaatcagaactagaattctcatacttttccccaccccgcccaacaaacagcagagcacagataaagaacggccggatttccatggccctgcattatcggtgacatcttctctttgttaccatccagaagagaactgctgcactgacaggaggcaggcagacacccccagagcgccacaacacctgcagccagagacctaatgcaaaacaaaaccaaacctcaggctgaatgtgattttctgtgtgatagggaagaaaatgagatagagaaatgtgaccgagcgcgtgtgcagatacgttcaggggcacaagtctgaatggtcaactcaaaaatgtcattcacactctcagacgagttcagaggctacctcattggtggggaggaggactttaagcaaatcatataaattagactaatctgtgaatatctgactgaatctgcacccttagaaaataaaaattttgcatattttttaaca

SEQ ID NO: 78331 - DNA, 463 bp, Homo sapiens
atattatgaataatgctcctgttgacattcatgtacaagttttcgtgtcaacatatgttctcatttctcttggatatatacctaagagtggaattgcggggtcatatggtaactctatgtttaaccccttgtggaactaccacactgttttccaaagtggctgtaccattttactttctcaccagcaatgtatgagggctctaatttctctattgtgccttttcttgtctctctagaacatgtgcctctcttacttttcagaatactttttccatgagccatcttcaattattattctttgttgtacatgtatctgcaagcccattttcctaatagtttgtgaccttctgagatgaaaaacatggtgcctgcccttaagagaatcacatctagaaaaatatacaatcaaatcagatattacagtgataataaacactgaaataaaggttattgctaaaaggtg

SEQ ID NO: 78332 - DNA, 118 bp, Homo sapiens
aggatggtaccactgcactgcaacctgggtgacaaagtgagacaccatttaaaaaaaaaaaaagaataaaacaaaaggcatatttaataacattccccttaaatgcattagcttttct

SEQ ID NO: 78333 - DNA, 320 bp, Homo sapiens
ctcctgggttcaagtgattctcctgcctcagcctcctgagtagctgggattacagcacccgccaccatgccgagctaatttttgtatttataatagagatggggtttcgccatgttggccaggctggtctcgaactcctgacctcaagcgatctgcccgcctcggcctcctgaagtgctgggattacaggcgtggccactgcgcccaggcacattcctcccttctgcccctctcagggccccttcccaggtccctgatctccaggcttggcctccagagcagcccacaccaaccccaaaataaaaaaatgtatatattcc

SEQ ID NO: 78334 - DNA, 417 bp, Homo sapiens
ggccagggactgtgagtaaattctagaatatgcccttttggatatccaggaactcctgttaccttcttttggtaggttttcagtttctggaagcatagcattgttttagtcactggatttattctgttagatgaactgcatacacaaacttcagattttaatgttttcatttcattgaatatatgtatctcctgataatttatggaagtacttgacattagctctaatgttttgcagaaacacctagtttatacatttctagtaaggctttatttgtagaaataactctcatttataagtgttttttgaagcttcatgctctctgcctctttaaagagaagattatactctttcgtgaagattttttatgcttgtaataggagtggttaacatttatggaacatctactatgtgtca

SEQ ID NO: 78335 - DNA, 773 bp, Homo sapiens
gggaggtctctcagttaaacaaagttattgacttgtctttagacaggcaagacagagtatctcctcataaggttttcttttaacctttttgttctgaagttaatatgtcttttaagtgaataatcttgtttataacaacattttcttttctgttttgtttgtttgtttgtttgagacagagtctcgccactgcactcccagcctgggcgacggagtgagactccatctcaaaataaataaataaataaaaataaaaactgaattgatgacagcccaacctgtcacttttttcagatccctttttatgaaagaatttgcttaagttgtgtctgaagacaaaccaatttctttggaccctgggtattctttttctaagggaataccatgttattttgtgttacagattgtttgcgatctttcataggctgatctttctagagttggttaatatccatgtaggttagattgaaaaacttgaattcagaaatgtacggtgttggagcagacatggatctggaagccaagaatagcgttggtgttgttgttgatggtgaatctgaaagagtgggcagatggcaactttttgccagaatcattcagggtcaaagggctagtcatatttacaagggaaaagaggaaaccatgttattaaatatttcatgcaccatatgttcctttcaaatttcagtggcttgactaagaaaattcacttttgggagagttggtacaacaattgaaagcacttagtagtcaactttttccttagtgtttcc

SEQ ID NO: 78336 - DNA, 1077 bp, Homo sapiens
aatgacctggatttgaagaccagtttatccatttcctggtctcatgatcttcagcaatttgcttaacctctctgagactgagttgcctcacctgtaaaatgggggtcataattacacctacctcatagcatttttatgaggattaaatgagataatgtgtgcaaagggcttagtacagtacagagtataagtacagtaactattaacatttattcagcttattaacatacatactttatgtaaatattaattcacttgttcttgcagtaatttggtgacttctcaggcatctgaaacacacagattgaaaaacactgctggattcagtaggaactgggacaaagggtatcttcagaaagaataatggagacctgtgttgttgctgaaggagatggagcttgggacttggaagactggcagagctgcttctccttaggagctctggctgctactggagcagccccaggaaggctctgtcactaggaacaagagctaccactaactgagttagtccctgggagctggacactgctgctgacaagtactgccaagatggtccgtggtggtctgcctctgggaccctgctgactacacacaacaatggaggcttacaaaagaggaactaagaaaatccaaagatttggaagtgtctgaccctttcttccctttatggcttctcacttgcacagaagaatttcagcccaactctccatgcaacatccaataggggacaaaatactatgctctatcattacaccctcattgaggagggtcaataatcatttctcaccaagaaagtaggaggtcagaaagtggatgaggaatcaacctagtttagaggattgatctagaatcttgtcctcaggcttctagggaattatctgagtcttttatctaagacaaatgcaacagttttctttccaaatgctcagaaaaatagtgatgatgatgatgatgatgatgttcatttgtatacatttacatgcaaccacagcattgtttttattataataccttagcaataactaatgagaacatgttaggtgatgttaaataaaataattttttcccaaagac

SEQ ID NO: 78337 - DNA, 814 bp, Homo sapiens
catctggggcaatcttaagtgaaactggctttttctgtgagtgcatgatgaagaatacagtgactactgggacagtttgataacactgcctagattcatactaagacaccagctcttttacccatcatcagttttgtaccattaatgcaaatgtcaatcaattgagaacaatttgtagtattattataaaaatagctttaacctttcagacccttgaaagggccttggggaacatactctgagaagtgctgccctaaatagtaatagagaggatctgtccaatggtgtgctaagaatctcttcacattccccaggaagagagacatagctgcagacatttagagtagacataaagttaagtgtgttgctttaaaatcaagagtaactactaaaaaaaacccagacacatctatagttttcaaattagcacggctaaaaaaagggaatacagaaatcaattcaatagaagaaaggaagagactcagaaaaagggataacatcttgtgtgtgatggctcatgcctataatcccagctgaggtaggaggacctgggcaacacatagtgagaccctgtctctacaaaaaatataaaaaattaaccagatgtgctggtgtacacctaaagtcccagctgcttgggaggctgagatgggaggtttgcttgagcccaggagattgaagctgcagtgagctgcgattgtgccagtacattccagcctggatgacagagaccttgtctctttttaatgaaacaatgggcaaaagaagttcaagaaaggaaattagaaaccaatctcatgagtataaaaaaaaa

SEQ ID NO: 78338 - DNA, 770 bp, Homo sapiens
gtgattttcatgaaccctcttttgtgtggaatttaattgcatattctgatgcttcccctaacattttatatgtacttttattatatattgtagctcctgccttgtattgcaattggctattttccatgccggtctcattttagatgagcttccttaaggacacaatgtgttctgtggcataactttatgtgttcttgtggggactaaatattgtactatgtaattattcaaaaaatttttttgaataaattattctcatttttcttaacttcagagcattttgctttgccattgggagattcacatttgggtcaagaagaatttgatgcaatgtacagccaaaataaaaaaattgtttttatagatatatctaaatttccatcactctatcatatttttacattccattaccaatgagaattacaaattatgtatttctcttcttctgtgttcttatcttttaatttttacctgtggtatgttttgaaatttatataacctggctagccctcttagatagtcttagtgcttttctttggcctaaagagaggcagcatcagatctacaaccttttttcacctagacagaatagttgctggtggtctttctgtgtttcgtaatgttctatttatttaaaaatgaaatgaattggaatggcgagatgtaaaagtttttgaagatcactgattaataaatctgctaacctgaacatgatatgaacaaaatactctgcaatgtatttccttgaggagattaggaaatatatccat

SEQ ID NO: 78339 - DNA, 376 bp, Homo sapiens
caatcaaactaagtgcacccttctgcattcatatggaaccattctgaggttacagtcctccgtctttttctctcaaatggaagttctgcgaccgacttgaggctgcgacactgaacacgatgaaaagccatgttcaagtgcgaaagccagggtgacgcttaggcctggtcacagttccgggacgtgggtccatacctccccatcctcgcaccagcctggaagctgtaagacaggctaagacttcccagataggcccggcacagggctataagagaagaatcacaagctgacctctaagtgagccctcaaacagaggctctatttacacccctccatgagtagctttttttttttttttttttttttttaaggcaga

SEQ ID NO: 78340 - DNA, 563 bp, Homo sapiens
gtctcagtggcttcaggagtgaagccgcagaccttcgtggcgagtgttacagctcatgaaggtagtgccaacccccaggtgtgcagcagcagaattttctgtgaggagccaaggaacaaagcttccacaccgtcggaggggacccaagctggttgccggtgcgggctcgggtggcctgcttttattcccttatttggccccacccacatcctgctgattggtccattttacagaatgctgattggtccgtttacagagtgctgattggtcacttttgacagagcgctgattggtgtgtttacaaacctttagctagacacagagtgctgactggtgcatttacaatcctttagctagacagaaaagttctccaagtccccacctgacccagaagcccagccagcttcacctctcactatctttggaagccatagataattttggagatgtttgttacctcagcataacctggactaagctgactgatacactctcactttacaaacaagggaaccaaagttcagaaagtcaacagacttggtaaacatagagtggcatgaagg

SEQ ID NO: 78341 - DNA, 1412 bp, Homo sapiens
gcgagcgccgggaacgagcaccaccagggcttggcagcggacggctttagaagagcctagctgctgcgcgcgtcggagaggctcctgggaaactcccacggcccagggactttcgaaagcagagcgaggagccctcgcacgcgctagtctgcgagtgagcgctcagcccggcacctgttcctccagcgccgccgccttcccacccctcggacccgcgccgctcgcggcgcccgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttctccacccgcaggtgggccaagctctgggggcaggtggagagggcgggcaggggagagacccagcggcactgatcgccttgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgtt

SEQ ID NO: 78342 - DNA, 1472 bp, Homo sapiens
gcgagcgccgggaacgagcaccaccagggcttggcagcggacggctttagaagagcctagctgctgcgcgcgtcggagaggctcctgggaaactcccacggcccagggactttcgaaagcagagcgaggagccctcgcacgcgctagtctgcgagtgagcgctcagcccggcacctgttcctccagcgccgccgccttcccacccctcggacccgcgccgctcgcggcgcccgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttctccacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgtt

SEQ ID NO: 78343 - DNA, 1734 bp, Homo sapiens
gcgagcgccgggaacgagcaccaccagggcttggcagcggacggctttagaagagcctagctgctgcgcgcgtcggagaggctcctgggaaactcccacggcccagggactttcgaaagcagagcgaggagccctcgcacgcgctagtctgcgagtgagcgctcagcccggcacctgttcctccagcgccgccgccttcccacccctcggacccgcgccgctcgcggcgcccgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttctccacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgttttgttcctggcctcctggtggtcattctgcgctccccagcaggggggaacggggcggcggtgaggagtctggctcccggccagggcaattaaccctggagagctgcgattcaacttgtggatcccctggaggggcgagggtggggccagacggagaggccctgggatgactgagaaggagcccagcctcaggcacagtagccgtcctggaggcagcatcctttgtttcctcttatcgtgaatattttatatttcatttagtc

SEQ ID NO: 78344 - DNA, 2915 bp, Homo sapiens
gaggtctcctagagcccattgaggaagaggaactttctcagtaggacactttataagcctgagaaagctttgaaaaggcggaatgagttgattcatttccacctcaaaaggaacctttccaggtccccctggaaattgtgccctggagatgtttaacaaggagaactggtgaggaaagagtccttttttactgtagggaaaagccccaaactggcctcctgggggatgagggctgaaatgatcccgaaggccttttaattagtgtgaaatcctgctgtactcagaaatccttccccgaatttacagcacaggcaggatgacctaagaggcagtttacttccctgagacccacagttgggctgttctggaaacacatctgtgaatcatagccaattgccacagagaaaacagaaccaagcctccggtgaggccactccaccccagagaagtctgcagaattccaaggactcggattggatgttcagaattcagcaactggaaagtccttaaaaacaaacaggccaaaccaaatcaatattgctgtttctagatgtcccttctgtggttgagctagttttacagagataaatatattaagacaaggaggtgggggtgttatatgatcaatgatagccatttgaaagagagggaggagtacagaaggaaggcacttctgggtacttaattcagaaatttctttatatttcagcactggattatcatataatgcaagtgactatggactaagagttagttatggtgtcttatgactagatttattatggtatattaaagtaacaataatattaatattaccttccttttttttttgtttcaaaagagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattaaaaaaaag

SEQ ID NO: 78345 - DNA, 2396 bp, Homo sapiens
tgacagtcgcggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctctgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaa

SEQ ID NO: 78346 - DNA, 811 bp, Homo sapiens
tgacagtcgcggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggaggaaggatggaggcgaggctgcggcggcgtttcccggtccgccggtgtaaggagaaagaaacatttgatcagcccttggtgccgacgctgcagaagtagggaaacctgaggctgcgggagagtagcctccagggctgagcagaaacagtcgccaggacttgggggaggggaagtcggggactgcctgggcgccaagacctttcacaaagggggaaaactctctcagtgcaaagtttccctagaaatatgcagatcgctgagaagggaagagtcactggtgcctgtcaggggcctcctggcagaatttaaaaggcataaatattccctggaattgggaaaatgttattttgcccaaaagatccttctctacaagctaattaaatagatgtttgcaaaaagtatgagatctacataaaccttgataacaatc

SEQ ID NO: 78347 - DNA, 418 bp, Homo sapiens
aacgagacaaagtcattgccctccatgaactaacaatctacagggagctgtaaaacaagtacatgtgcaattcccggcctgggtttgaatcccagcacttctagctgcacaactttacccaagaggcttattctttctgagcctctggctctgcatctgtaaaatggactttacattcagtttctttatctggcaataagaaaggctttatagctactcccagggatgcataaagcacggcaaaccaacaaaggccaagaggaggtgagaaagaaaaacaaggagacaaccatcaaatggagccctgggcccgaatcttcaaattgctcctgtcttctccttctaagaggtgccacctgcagtgggtcatgctcctggctgatgctgctagaaaaagaactcatctgtatcactggcg

SEQ ID NO: 78348 - DNA, 3409 bp, Homo sapiens
tgacagtcgcggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattaaaaaaaag

SEQ ID NO: 78349 - DNA, 3398 bp, Homo sapiens
aacgagacaaagtcattgccctccatgaactaacaatctacagggagctgtaaaacaagtacatgtgcaattcccggcctgggtttgaatcccagcacttctagctgcacaactttacccaagaggcttattctttctgagcctctggctctgcatctgtaaaatggactttacattcagtttctttatctggcaataaggaaaaatccaaatggatttctcactttttgaccagatgtttcattgtcacacagcccgtgtgacagcactggcccctagtacaggcagagttgaaaagtgatgtgatgggtcatggttgcccctctactcagagaaaactccttcttgacctcatcacggtcgctgaaagtactaagaattatatctgaaatcaagcactggtagcagaacacaaatatgttaccaaattagttggaagaggttaggagcttgtaaggaagaccatagcagttgaaaacaaagcaaggcacatttccattgtacgtcccaggagtagtttgaatggtttaaggaccagctatgtgtgtgcttgcataagcgtatgtgccctgggtattctgcagtgtgtggggagctggcagtgtgatgaaggggacaggattctagatgagctactccactctgaagaccctatgactgtatccactggcaagaagtttgaataaaggcccttttactctttcatgccagctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattaaaaaaaag

SEQ ID NO: 78350 - DNA, 3099 bp, Homo sapiens
aacgagacaaagtcattgccctccatgaactaacaatctacagggagctgtaaaacaagtacatgtgcaattcccggcctgggtttgaatcccagcacttctagctgcacaactttacccaagaggcttattctttctgagcctctggctctgcatctgtaaaatggactttacattcagtttctttatctggcaataagctgcctgtggaaagaaaggcttcttcttccaacagatgagtattctgcagtgtgtggggagctggcagtgtgatgaaggggacaggattctagatgagctactccactctgaagaccctatgactgtatccactggcaagaagtttgaataaaggcccttttactctttcatgccagctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagacccaccttctcacttcctccagcaacttcctaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattaaaaaaaag

SEQ ID NO: 78351 - DNA, 1839 bp, Homo sapiens
atgaatgacgaagactacagcaccatctatgacacaatccaaaatgagaggacgtatgaggttccagaccagccagaagaaaatgaaagtccccattatgatgatgtccatgagtacttaaggccagaaaatgatttatatgccactcagctgaatacccatgagtatgattttgtgtcagtctataccattaagggtgaagagaccagcttggcctctgtccagtcagaagacagaggctacctcctgcctgatgagatatactctgaactccaggaggctcatccaggtgagccccaggaggacaggggcatctcaatggaagggttatattcatcaacccaggaccagcaactctgcgcagcagaactccaggagaatgggagtgtgatgaaggaagatctgccttctccttcaagcttcaccattcagcacagtaaggccttctctaccaccaagtattcctgctattctgatgctgaaggtttggaagaaaaggagggagctcacatgaaccctgagatttacctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtgatatagtatgaggcccacaacagttgcttatgttcataagcaataagagctaggatttcaacccaaagactgccatcaagtctcacagctttctttttgttgaaaaaaagggggcatggagtagaggaagaagcaagcagaagaaatggggagaagctagagaaagaagaaaaaaatgggattctttctactgaaatttctaaatgtggaactcattgtctgtactggctttgaggcagaaaaaaaaacctaagagtttaaatatt

SEQ ID NO: 78352 - DNA, 1191 bp, Homo sapiens
aacgagacaaagtcattgccctccatgaactaacaatctacagggagctgtaaaacaagtacatgtgcaattcccggcctgggtttgaatcccagcacttctagctgcacaactttacccaagaggcttattctttctgagcctctggctctgcatctgtaaaatggactttacattcagtttctttatctggcaataaggaaaaatccaaatggatttctcactttttgaccagatgtttcattgtcacacagcccgtgtgacagcactggcccctagtacaggcagagttgaaaagtgatgtgatgggtcatggttgcccctctactcagagaaaactccttcttgacctcatcacggtcgctgaaagtactaagaattatatctgaaatcaagcactggtagcagaacacaaatatgttaccaaattagttggaagaggttaggagcttgtaaggaagaccatagcagttgaaaacaaagcaaggcacatttccattgtacgtcccaggagtagtttgaatggtttaaggaccagctatgtgtgtgcttgcataagcgtatgtgccctgggtattctgcagtgtgtggggagctggcagtgtgatgaaggggacaggattctagatgagctactccactctgaagaccctatgactgtatccactggcaagaagtttgaataaaggcccttttactctttcatgccagctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaaggtaagagagctctacccacaggggcctgcaagatccagctccatcttaggcccaggtcacctgtgtggatgagtcaaggacagtaccacctgttggtcaagaacctggaccctgaagtcaggtaataaggacccaaggtcaccctctgctgcttgttggctgtgtggcctccttgagcttcagttttcatttataaaataggcatatattgcttacttcaagtgttggtggaagagtaaatacagcgtgaaagtgcttggcatattgtgggggcttaatatgtgtcatagtcgcaatt

SEQ ID NO: 78353 - DNA, 3570 bp, Homo sapiens
atgaatgacgaagactacagcaccatctatgacacaatccaaaatgagaggacgtatgaggttccagaccagccagaagaaaatgaaagtccccattatgatgatgtccatgagtacttaaggccagaaaatgatttatatgccactcagctgaatacccatgagtatgattttgtgtcagtctataccattaagggtgaagagaccagcttggcctctgtccagtcagaagacagaggctacctcctgcctgatgagatatactctgaactccaggaggctcatccaggtgagccccaggaggacaggggcatctcaatggaagggttatattcatcaacccaggaccagcaactctgcgcagcagaactccaggagaatgggagtgtgatgaaggaagatctgccttctccttcaagcttcaccattcagcacagtaaggccttctctaccaccaagtattcctgctattctgatgctgaaggtttggaagaaaaggagggagctcacatgaaccctgagatttacctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattaaaaaaaag

SEQ ID NO: 78354 - DNA, 3254 bp, Homo sapiens
tcaagttcaattcagcaagtatttattgagcccttacatgctgccaggcattgccctgcgtggacattaaggcaaaaactaataatatcaggctaccgccctttgaagttgctgggacatggttttagtaaggtctcctcagacctgcatttgggtgttacaatcttatgttccccttgctaattgcacctgcccactcaggacactggttctcttctttccaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggaaaacttaagcgaacaggacctgctgcacacagccccattgtcttctatccatttctctttatcattcaaatcaagcaacatgtgccctcctcatcaacacacattcttcccctttgtcagtatgcatctcccagcttagtgtcaggatactttcgattcataattatgtatgatccaaagtgtgcataatttcatttaacgttaaagaaatagatccaattcctttcttgcaaccaaaaataaataaaatacgttgcctcaatataaggtttgggctattctgtgtttctatagaagcaatctgtttttggtaaaatgtacttttaaggatccagtcatctgaagtattttatgtagagttagagatttcacaatattgactatacatatatttaaaatataaattatccagctgatgtttgaatttgtcttactttcctggccacctcgttgtcctattttataagctggggagttaactagcttaacaaaagatgcttagcttttgtaaaagaacaagtgtttcattttacaaagacactccaaatgatagttacttgattttctcgagacctttaactatggtgatgaataacaggacttgctttcaagccttaataaatgtaaaatgccttttaatgaagatacagctgagtgttttcctcatgaatctgaaccaattaccaatttgtgttccagtcttgattggtattgactgattcaaataaagttggtttattttcaaatattaaaaaaaag

SEQ ID NO: 78355 - DNA, 3165 bp, Homo sapiens
atgaatgacgaagactacagcaccatctatgacacaatccaaaatgagaggacgtatgaggttccagaccagccagaagaaaatgaaagtccccattatgatgatgtccatgagtacttaaggccagaaaatgatttatatgccactcagctgaatacccatgagtatgattttgtgtcagtctataccattaagggtgaagagaccagcttggcctctgtccagtcagaagacagaggctacctcctgcctgatgagatatactctgaactccaggaggctcatccaggtgagccccaggaggacaggggcatctcaatggaagggttatattcatcaacccaggaccagcaactctgcgcagcagaactccaggagaatgggagtgtgatgaaggaagatctgccttctccttcaagcttcaccattcagcacagtaaggccttctctaccaccaagtattcctgctattctgatgctgaaggtttggaagaaaaggagggagctcacatgaaccctgagatttacctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaagtttcatctcctaaaaagcttacccagcctgagcttggggacctgtgcagaggaaactaagaaaaatgcactcatcaactccttctcccagtgaacgcccgagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagcattttggtggcacagaaaggggatgtatttgtgttgagatcttattttattttgtatttatttatcttctttgacttgcacagcactattgggggtgggggaagcagggtagtgggagacgaaggcagaagcaagagtcaaactcagaatgactgagttgaattcactgtctagtcagcaatgcctgcttctgagtttggcccagagagaaggtattgagtaagattttaataactgtaaaaagtaagctggataagtaaaatcatgatggatccaaagcacagtttcttcatctcctgataaagaaagtcaaatgcttgataaattcagagtcacagatgtgagcatagctatattcttttaaacgagaggtagagtgacctagcactaagcaaatgagctgaaatgtcggaaacagagtccatcagcttatttggccacacgatcccaaactagttttatcttgggaaatggccctgtcctcagcattcccttcttgtgctggtggggccagtgaagtcttgatcttatcagaaaaaggccacaccaagtgcgagttttcccaggctgactttccaggcccttatcaaatgaaacaacagaagctcttcacagttctgtgccccatggccactccacagacagacaataccaagcatcttagaactgtcataagataggtcatgcctgaaatagatcttgaccatatgagagtcccagaaatcagcaaggcctggacaaatagaactaagagagaggcagaggcaggaagctgcgggtctatcttgtaaagagtttagcatcactgtgagagtgtgtgtctaaaattaaattaaactagaagcagcaggtgagtatttggtaagtacttctgtgactcgcctcaattcccactggccaggggccatctcaactgcacggtgaatcaagatgctggtgtcatcctccttggaaaaaggaaatgttaactcatggttaaaactaagtacaatgattcccaagggatcactttcttatttttttaaatgacattaaggagaatcttaagaaagcatcagagaaagacatgtgcatgtgaagcaccctgattctgatgttaggtctacctggccaggtagacctaacaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctgggttaggtctacctgg

SEQ ID NO: 78356 - DNA, 2342 bp, Homo sapiens
tgacagtcgcggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcataaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctctgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaa

SEQ ID NO: 78357 - DNA, 340 bp, Homo sapiens
gatgggagcccaacaatgtgattgcaactggctggcatgaagaaaagggctaaccctcttacctgggtgtttcaaaaacacaaatgctagctgtgagtgaggtgtgagcacttgatcactacagtgatctgggctttagctatggttccaggaagctggttttctgcacaggctgatcagtttcttccttggaagggacacctctctctagcaccagccaggtgaaatctggctggcttacctgccagggtaatgaaatgatcaggcttattttgcctgatcagacacaattcattagggcgggacaggcttcagagccaccttcaggagtgaggctctt

SEQ ID NO: 78358 - DNA, 422 bp, Homo sapiens
gaattctttacaaaaaaattagcaaataaaattcatcaatgtatggaaaattatacaccctgaccaaatagggtttgtttcagggatataaactggctcaatattcaaaaatcaattaacataattaattattttaacaggctaaagaaatcacatactcatatcaatcaatacagaaaaatcacttaacaaaattcaacatccattcaagttaaaaaaaaaaaaacctcagagaaacagaaatagatggcaacttttcaacttgacaaagggcgtctgcacaaatcctccagctaacattgtatttagtagtgaaacactgaatgctttttccctaagattggaaaaaaagcaaagatgtctgttctcattactcttattcgacattgtgctggaaatttgagccagtgtaataaggcaag

SEQ ID NO: 78359 - DNA, 407 bp, Homo sapiens
cctgttactaagacatctacaactgaattggtaaaatccacataggaaaattggacaatgacacaaggcaatacgggatctggtctaagtaaacagctattatgggttcagaaggacaacccattgagatggcaacgttgtgcttccaaacagggctggaaatctgcttcaacgcaccgtgaaaagggtgtgcttaactacacctgctcacttagaaaaaaacacaaacatttccctctgggaacccagcctgaatttgtttgctgacttgcatgcctctatgtgtgtcttcacctgttggggttggaggctccccggcctgcctccctccgtgtttctgccacttcccttatcttgaaatagccatgaccatcggagaactaggtttcccttctccccttttctac

SEQ ID NO: 78360 - DNA, 393 bp, Homo sapiens
aaaaacaaaccagaaaagaaaatcaagaacagagcttaattaaacatgtggaatatgtcatgaatatttatgtccccaagtcttgccttgtgatggtatttgtacttaaagtgctttttctcctctttcctgtgaaataattcagaatgtgtttcattaatacaagaatgtgtcatgttaactttcatcaggaaaaaatttcacttctgacaacactgacacctttctgattgaaagtatgcaaaatagctcttacgttaattggtcccaaagaaaattatgttatccattttcctgtctatacatctgacactttccctcatctgtcacctcctgaattatcaatgctttcccttgcctgattttgacagccagtattctgcctatgacttt

SEQ ID NO: 78361 - DNA, 309 bp, Homo sapiens
cctctggtgctgctgcctattggtggtgggggccgcctggaagctggggtagggactctaggctgtgtctgactcagggtaaggagtgcccattaggtgctacagttgcccctgctgtaggaaggaagagctccttgttggccattcctgctctggttcaacccctttattcagatgatgacactgacactggcagccacaccgggagctatgctcaggagcgagagtaatcagccagccctataagaggggacccttcccctctcccagccctttcttacgccatgaggaagcgggctccagcctcgc

SEQ ID NO: 78362 - DNA, 551 bp, Homo sapiens
gggaaagggaaaatcgggactgactcagatttctgaattgggcaaccgacggataatgctgccatttattggcataggacagatagaggaggaattgattcatgcaggggaaatgagaagttctatcttggacacgtttaatttgagatgtttgtaagacatccaggttgaactgtcaagtaagcagagctggatatggtgctcagaaaaaatgggttgaagacacaaactttggagtcttgagtcataatgagatttttaaagctgtgaattaatggaaccacccagtgaaaaatgataacaggagaagagaagaggacccaatactgtcaacacttaaaaggagaaatagcagctgggagaaaccagtgagtttggaaagcagagaaccaatggcctgatgataaccaagagaagagtattttgagaaacaaatggcccactccacccaatgctgctgaaagggtaagatgaagacagagaagtgtacattcgcatgtggctatgtggatttccagtgaccctgaggcaagaaattttagtacagtgac

SEQ ID NO: 78363 - DNA, 382 bp, Homo sapiens
ccacagtactatgaaaatctatgttttttaaatgaataaaaatagtaataatcattatcatcattattccatcagaagagtattattaagtgcacatctcttcatttttgcccacccagtgaaaaatgataacaggagaagagaagaggacccaatactgtcaacacttaaaaggagaaatagcagctgggagaaaccagtgagtttggaaagcagagaaccaatggcctgatgataaccaagagaagagtattttgagaaacaaatggcccactccacccaatgctgctgaaagggtaagatgaagacagagaagtgtacattcgcatgtggctatgtggatttccagtgaccctgaggcaagaaattttagtacagtgac

SEQ ID NO: 78364 - DNA, 379 bp, Homo sapiens
aaggcccataatgcccatttgtccctttattggtgatgttaggcttgatcacttggttaagctggagtccaccggatctctccactttacaatttaaagaaagctgtggaatgatattctgagaacttttagctattttcttcaagcaacatattaccccattgttttatcccccacattgatgatctatacttaaatttgctattacactggggattgcaaaatagtgactctctaattctgtaattctatgaactcaaaatatctgagacaggtctcaagtaatttagaaagtttattttgccaaggctaaggatgcacacatgacagcctcaggaggtcctgaggacaggtgcccaaggtggtcacggcccaatca

SEQ ID NO: 78365 - DNA, 420 bp, Homo sapiens
ccaggacggaatgcacagcacccttgggcagcaggtgggctgcagaaaggggacaggcgggaggagcaaggctgcagccccaagctttccagggagagtctaaaaattttgtgattttctgcagcagaagtgtaaggtctgtaatctcctctgctagaatatctgggaagattcccttagccaatattagggcaaaataaactgtcttcttggtcgggagtggtggctcactcctgtaatcccaacactttgggaggccgaggcaggtggatcacttgaggtcaggagttcgagaccagcctggccaacatggtgaaaccccgtctctactaaaaatacaaaaattagccaggcacggtggcaggcgcctgtcatcccagctactctggaggctgaggcagaagaatcacttgaacccgg

SEQ ID NO: 78366 - DNA, 365 bp, Homo sapiens
ggctagtggggacagggtgggcggggggaagaaatcacctcctagcaaacatgcctaatatgaaataatgctgtttgcctaataagaaattaagaaaaataaaattgtattcattagaactgtacattgagtatctgactcaatacagtttaacttagtctacaaaagaaatttgttcctaaaaagttacatgtgggttgagtttacataaatgaattaatcttaaagtcaagaggaaaacaataacattctatagtgagttcttctacaaagcaaaatacgtattcataaagtgaatcgctccctaatgtatttgcctaatttagacttaaatatataatgttgacttaaaacaggatgataca

SEQ ID NO: 78367 - DNA, 464 bp, Homo sapiens
gtaacctgactgagtcctgggcagatgataacccccgacaccatggcctggctgcccactcctcaggggaggaaagagagatccagtatgcacccctcagctttcataagggggagcctcaggacctatcaggtcaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtgt

SEQ ID NO: 78368 - DNA, 416 bp, Homo sapiens
gcctggctcatcgctgtcctttcctccttgtcagagtcagtgacactgacattaaggtcatcgaatatcaaccaggtcctgaggaccttggtgtgtttcctcctctcctagtctccagaccccagcctgttcattcctgagcttcctctggcaccccttccttggggccaagccaagtaagaaatcagcaggcccaaggtggtgcttgggaggccggggcagtgccaggggcagtcctcataccatcctcccactggcttccctcctgcctgctcttagccgccacacatatctcagctgtcgaatccgattagggctcctgcccagtgagccagacaaggaggccactgggcaggggagagagagacaaggacgccaagcagggatggcagaaggaaggtggagacatggctcag

SEQ ID NO: 78369 - DNA, 431 bp, Homo sapiens
acaaaacaccctaaaagaaaaatggaagagaaatgagtaacatgtgattagagaataaaaactcaatggctaatagatgcccaagaaaatagtaaaccctgccaatactgcaaaatatttgaaatacggtaatgaaactggctgggcactggctcttgcctctatttctagtgctttgggaggcagtggcaggagtgttgcttgaggccaggagtttgagaccagtctgggtaacatagcgagacccccctctctacaaaaaataatttttttaaatgagccaggtgtggtggtgcacgcctgtagtctgtttcttggaagcctgaggcaggaggatcacttgagcctaggaatttgaggctgcagtgagctctgattgtgccactgcattccagcctgggcgacagagcgagatcctatctcaaaaaaaa

SEQ ID NO: 78370 - DNA, 764 bp, Homo sapiens
cattgctggtcaccccctttggagcaccatctgtacatgcccacagtgaacccgatgcccaggagtctgtggacattcttacaggctgtgtcacagcacaaatgccagcccagttggaagaagaccataggcctgtcattctaaatctaagtttaagaatatttttaaagaattgctaccaagtgtagagttgggggtgggggtaggattgctttaatgaacaggaaaggatcattgataatcaatttatcagtttctcagagcggctgaatggctgctagccttgaactcctctgggattttgagggttgtggctaatggtctaagtgcagatagcaagggggctcagttatgtagtgcttgctaataccatacagtcctacacttgaaagaatccttgatcctaaattacattcaactcagatatctggttagcaaaatagatagaaaaaaaaaaggagattcctgagttattcctaatagcagtaccataatgtgcataataaaatgactttagttgcaatatcttgaaagatcataagatgggggtgttgctccgctagagaaagagaaattcatgtttatgtgattatccatgcagacttgatctgcccaaggcaagaatgcatgtatttaataatcataaatttgttcattttcactgtacagggtaagtacaggccaccctgtaactgctactggtaatgactttatgtcattttttgtaagttatgtgatattttaaatctctctttcttttgccc

SEQ ID NO: 78371 - DNA, 554 bp, Homo sapiens
gcacgaggttgtcagaccagctctgagctgcttcactagccctgcctctgacgggagtgcattctgcctctcccctcagccagcaaccccacacctggggtcccgcccatgtccgtgatgactcaccacgcagccctgcttcaggaggctctggctctggggagacagactcaagaagccgttgagtggtgagggcagccagcagcaggggagcaggggtggtgcccttggagatgcttcccacattgggttctaaaaggtgagggcggcagctcgatgctcaggaacaaatcctgggcagaggctggaggaagttggaggtggtgaaggtgaacagttcagggctggggtgtggcttagtggctgctgtgggcagaggcaggaggggcagccctagagcagcaccaggcctgacttcacctaatactgacttactcattcagtaaacgctgagcacacagtgtgcctgtgctgggctaggtgctggggatgcatcgatgatgcatctatgaaccacaccaacaaagacccccgtccttgtgggagtgacaaaa

SEQ ID NO: 78372 - DNA, 521 bp, Homo sapiens
tttctgttttcatggtcagggctgcctccgttgtcttgaatagtgccatcaccgttaaaatttttggatttagagtataatgagcctctttttgcttacaggcaaaggggagcctataactaaacaaaatgaggagaggcccctcacctagacactatgattctttcccttgcatcctttgagagaaatgctagggagagacattggagagagtggttaagagcacacactctactcccagggactatccagtaaggtggggaagttctataaattctaataaagtcaaagaaaaaaatgaacccattatagaatctaaaaattaccattccaaagattttcagtagctcactgtctcccagacatctgagaatcagactcaattaaaaatttcaataatagagtaaccatgggaatgttattttgttcaggcaaaataacaggaataccttaggcagcttttttctaaatattctgctaaaaaatgtctgcatgcttttatggcagtttgctttaatgaa

SEQ ID NO: 78373 - DNA, 159 bp, Homo sapiens
gacacccatatcaccaagccccaggcagcatgtgcctctgagtcctgtctgaggtcttctgcctcccccggagattagagcctccattgggccagggatggggtccctttaccactgtgtccccagttgctggcctgtggcacttcctgaatgcctatg

SEQ ID NO: 78374 - DNA, 169 bp, Homo sapiens
gttttttaagtagaacaagaatttaggctcttcagatgaattcttagcttaaaatccttatagatctttacaatattttttccatttctttgaactattttcttggcctctacctaattcagcagcagaagtatttcacttttattgagtatttcagagtcattcaact

SEQ ID NO: 78375 - DNA, 255 bp, Homo sapiens
atgggagacttaaaagatacaccaaaagtttaaaaatttataaaatggcaagacgacttattagttctagggatggatgcatgaatttttatctataaagaaatgcaaggtattaattactataaaaatttggatagtggttaattttgggtggagggagggagttgtaattgggatgtgggacatgtgaggggcttctgggatggcagagttctatttcttgacctaggtggtagttacagggatattggcctt

SEQ ID NO: 78376 - DNA, 396 bp, Homo sapiens
gttgtctactaaacaaattaaaaaataaaagactgtatccaaccagataaggactcaaacaagcacactcttccatgatcagttctcatgggaggactctgtaaccgtaaaagagcaggccttcagcagctcgaaatagccatgttaactgatgccatcttgcagtcactggtgatgaaaacttggcatctgctgctgaagtctctgccacctcagagactctttcttgcaagaccagtggaccacccggcctggaccaggaccgcttttctcttcttctctccccttggactggtttgtgatcctttctcctatcccttttccttcttgtgttaaatgttagtttgtttgttgtgaaatgttaaacctataacatttacatattgattaagtata

SEQ ID NO: 78377 - DNA, 467 bp, Homo sapiens
  misc_feature (199)..(199): n is a, c, g, or t
cccagtagtcaggggtgagggggaatgcccttccaatatggctagagccagactgtctgggacccaatccccagactttgtatgtattacctaacctctctgtgcctcagtttaccaagctataaaatgggcataatgacagcacctgcctggtgatgctcttggagggatgaaaggaggcaacgtgtgggcatctggnacggcaccaggcattgccctgagagctggccatgcggggaatgctccatccttacggccagccaggtgttgccacccctctcttgctgatggagaccagggagggtcggggacagaaggccttgcccaaggtctcacagccaggagcctgcctccactggtccctgtgtggccagtgctgccctggggctgctgctgtgcactggagggtcagctgcatggaggagccagaggagatggtgccgaggacagagcttgcggccctgtac

SEQ ID NO: 78378 - DNA, 443 bp, Homo sapiens
gaactcctggtcaggtgcggtggctcacgtctgtaatcccagcactttgggaggccaaggtgggtggatcatgaggtcaagagatcaagaccatcctggccaacatggtgaaaccccgcctctactaaatatacacaaattagctgggtgtggtggcacgcgcctgtagttctagctactggggaggctgaggcaggagaactgcttcaacgtgggaggcggaggttgcagtgagccgagatctcgccactgcactccagcctggcaacagagtgagactccgtctcgaaaaaaaagaaaaacaactcccaatggccaaagctggaacaatttgagcaagaataacagaaagggtaatattagattatagttcaaaaaatgaacatccatgattccatacttatttatataagtgatatgattgaataaataaatgctgagag

SEQ ID NO: 78379 - DNA, 195 bp, Homo sapiens
tttaacttctctgagcctaaatttccacccttgtaaaatgtgattagaaatatcttccttgcagtcaggtgggtggctcacgcctgtaatcccagcactttgggaggccaaggcagccagatcacttgaactcaagggtttgagaccagcctggccaacacggtgaaacctcgtctctagaaaaaaaaatgcagg

SEQ ID NO: 78380 - DNA, 1221 bp, Homo sapiens
agccagtgggcccagagagatgccacaatgccatttgtaggctgggccctgggagaagaataacatcacccagttctgggcccagcaatatgttgtgatcccaactggaaaaagtttccagacaagagaggagaatcacatcatcatgatgataagccaagagatttcacaatccccccctctgcacatgtcccaggcagaagacctgaattacctttttacttaggccagtaatgtcacagtgcttcctcagggcagggcacaaacaagataggacagtcacatcattaagtgctagacttaatgctagatatgtcataaccttacttgtgggcaggatccaggaaggagagatttatgtcacctaggtgctcagtaaagagatatattacaattacaattcctttgagggaagtggccaggcaaaatagtcacatcacctaggtgcttggcccaggtataagtcacaagatatctgtgtgttgagcccagaaggactatcaaattacgaagtttctacgtagaagtgcatgtcacagacacctgcaggaaggcccaggaatgagactcccaattccacacattttcccactccaagtgtaagagtcaacaactcctgagacttaggcccaagtacatgagtcacaatctcaacagtggattgcatcctgccatgagagccccaatcccttctctaagctgtgttccagtagaggagtcacaacatcaatggtgtgctgaatcctggttggagagttcccacttcacctgtggactggatctgtatatgagagtctcaattccagctctcaactgcccctgggtgtgagattcaggacctcaattgtgagctgtgtacacatggacatgtaacaatttctacttttggctgtgtgttcatacaagactcaatctcatctgtgttctcggccctgttatgagactctctgtaccacccatgggatttattcaatacgcatgggtgtcataatcctctgtgatcttcatacaagtagaagacccaggaccttacccatgccctaggcctatctatgagaattgacatttttcctcacatttttaattttaacaaataagttattctcctctcagttcagattcatcaggacattgaatcatattcagaagaattaaaactgaaagactaataggtttgttaaagcaatgcaggttgtcatactaataaaccctaaaatttca

SEQ ID NO: 78381 - DNA, 1586 bp, Homo sapiens
agccagtgggcccagagagatgccacaatgccatttgtaggctgggccctgggagaagaataacatcacccagttctgggcccagcaatatgttgtgatcccaactggaaaaagtttccagacaagagaggagaatcacatcatcatgatgataagccaagagatttcacaatccccccctctgcacatgtcccaggcagaagacctgaattacctttttacttaggccagtaatgtcacagtgcttcctcagggcagggcacaaacaagataggacagtcacatcattaagtgctagacttaatgctagatatgtcataaccttacttgtgggcaggatccaggaaggagagatttatgtcacctaggtgctcagtaaagagatatattacaattacaattcctttgagggaagtggccaggcaaaatagtcacatcacctaggtgcttggcccaggtataagtcacaagatatctgtgtgttgagcccagaaggactatcaaattacgaagtttctacgtagaagtgcatgtcacagacacctgcaggaaggcccaggaatgagactcccaattccacacattttcccactccaagtgtaagagtcaacaactcctgagacttaggcccaagtacatgagtcacaatctcaacagtggattgcatcctgccatgagagccccaatcccttctctaagctgtgttccagtagaggagtcacaacatcaatggtgtgctgaatcctggttggagagttcccacttcacctgtggactggatctgtatatgagagtctcaattccagctctcaactgcccctgggtgtgagattcaggacctcaattgtgagctgtgtacacatggacatgtaacaatttctacttttggctgtgtgttcatacaagactcaatctcatctgtgttctcggccctgttatgagactctctgtaccacccatgggatttattcaatacgcatgggtgtcataatcctctgtgatcttcatacaagtagaagacccaggaccttacccatgccctaggcctatctatgagaattgacatttttcctcacatttttaattttaacaaataagttattctcctctcagttcagattcatcaggacattgaatcatattcagaagaattaaaactgaaagactaataggtttgttaaagcaatgcaggttgtcatactaataaaccctaaaatttcaaaggcttagcaaaataatacattttctgcttacatcaccatcccctttggcttatttctggttaagagaacttctttgtgattattcggagattagatttttttaaaatttcctatctgcactctctctttcttcagccaatagatgaaaaaagatgcaaagaagacacatttgctttttatgcacacatcacttccagtcactatgttgagcagagtcagtgtgaggacaattgagaatagcagttttctggcaggacagccacttctcagcagaagatgacacaataaaagtataaatctttcatgggaggctcacatattttcagcaaattaagcatatgcatgaataaaattcttgtggta

SEQ ID NO: 78382 - DNA, 406 bp, Homo sapiens
acctcgccctcctagtagctaggactacaggctaatttttttgtagagatagggtttcaccacattcagcccaggctggtctccaattcctgggctcaagtgattcacctgccctgacctcccaaagtgctgggattacaggcatgaaccaccatacccagcctctttctgtatttctatatttttaaaatttagttttagtgccttgcctttgtgatctgtatttggccactggtgtcatttttgtttctattatcgttctcagccacattcctacataggttagctgtcaagcacagtgcttgcaacacagagtagacagacaataaataattgctccattctttctgacatttcctcctgaatgcctcataaacacctagaactcaaaattcagtgaattgtt

SEQ ID NO: 78383 - DNA, 129 bp, Homo sapiens
atgccaagatacacagagagaatgatagaatgatactattgtataacacccgggagtcagtggagacagctgttctcagctatcctgaagcttaagggtcgatactttggcacacctatagcccattca

SEQ ID NO: 78384 - DNA, 396 bp, Homo sapiens
gatggtaatgctcgctcaccagcctgatgctcaccttctgctgtacgacctgcttcctaacaggccacagtgtggtactggtccgacctggggactagggattcctgctctacatacacaacagtagcagaatacacattctttgcaagggcacatggaacatgcatcaggatacgtaatgccacaaaacaaatcttaacaaatataggaagacttaactcataaaaagtttcttttcagatcaggatacaattaaagtagaaatcaatagcagaagaggccgggcgtgggggctcacgcctgtaatcccagcactttgggaggccgaggcaggcagatcatgaggtcgggagatcaagaccatcctggctaacacggtgataccccgttgtctac

SEQ ID NO: 78385 - DNA, 714 bp, Homo sapiens
cagcaagaatggttaatggatccccatttgactagcaggcagagactaatctggtcctggaatctgttcggccgggctgagcaagctcacaggttaattgagtttcccagtttatggctgcttagaggagatgatggctgcttagtggggagagagttcaggtggttagatttggatcctggctgtgttcatttatagtccaaaactttcagaagagggtgattttatctttttctttctcaggaatgtattagtggttcagaaaatatcacagacatggtgttaatttactgttttcctgctggggatataggatagtggaagagaggatggaggaagggaaaaggagcacgttttctagaactcagctgtcgtgagagacaagtgtaagcctgtgggtaggagcagctttccttgttgagcgtaggcatttggctcaggagttcgagcactgatagtggtggctcttggtggttattgtctgtgggcagggataatgaagggtgaccgactgtcccatttttagccctgaaggtcctgggaaacccccagtcctggaaaaactaggactgttggtaaacccagtggagggacaaagcccccaaatgggcagtggggcagagtttttggcctgagtacataaaagtgatgagagtcagagctgaggactcagagctgtcttgggagaaagagtccagaatttaaagcacttaa

SEQ ID NO: 78386 - DNA, 676 bp, Homo sapiens
tattcggcacgatgctggccttcaactgcttgggtgaggcccgtccccactacagaagacaatagtctgttctactcagagtctactgatttaaatgctcatctcatcccaaaaaataccctcacagcaacatttagcctgtgcatttgaccaaacaactgggtaccatgccccccctcccaagttgacacacaaaattgaccatcataccctccccacccccagtcttactgaatgagagagaatctgtgcttcaacaagatccccagaagaggtataagcgcagggaagtctgagaagcaccacctttgaggcttatccaggatgcccacatgagccttctctggatatgtcagatccccttccctggccccctagacacctcctccactccccaaacttggaagcaacattgtggggaagcaggcagtgaggcgctcagtctacccacgttgtgagatacacagctccatctgtgtatcatgatttgatccaagggaaaacaaaagatccagaaacataagtacttttttgtgagctctcaaaaacttcctgtgacaagatcaggtcgttgatgcgagagccacacttgtttctttttcctctttattctccacctctgacataatacttagcataaacaaaaatccaataaacaccactgaatcaattatct

SEQ ID NO: 78387 - DNA, 664 bp, Homo sapiens
aggggcctataatttctgttaacagaaagttttagttatgttgattcaactggagaggaacagagctcccagaaggactccagaacacttgatgcttgtctgagtggggtcagcagcactgagttcccaccagacagaaagtttgtgtgtgtacattatttcccttaactgccacaataatcccatgaagaaaatgccctagttttacaaacaaggaaacagaggcagagaagagttaaatgacttgcccaagggcattcaaagtaagcaactgaattggaattttaactcaaaggcttggatgtcccactacaacaaataggctgtttctgctttactacatgtgcttacttctaagaatttaacattttaggctggttgtggtggctcactcctgtaatctcagcactttcggaggctgaggtgggtaaatcacttgagctcaggagtttgagaccaacctgggcaacatggtaaaacctcatctctaccaaaaaaaaaaaaaaaaactagctggacgtggtggcacgcgcctgtggtcccagctactcaggaggctgaagtaggaggatcgtttgagcctgggaggtggaggttgcagtgagcccacattgcatcactgcactctagcctaggtgacagagtgagagcctatctcacacac

SEQ ID NO: 78388 - DNA, 276 bp, Homo sapiens
cttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaa

SEQ ID NO: 78389 - DNA, 462 bp, Homo sapiens
atatatattataacagatatgtatattttataataaaaatgccatatctttggcatgagaaggaatcccagaatctggggcatatgtgcatgcagactagtcgcacctataactccttctcctcaaactgtgtttttggctttggtggtaacaaatataagcattctgcagtttccctgttcttatcttgtcttccccccaacgcctcctcataaggtcttggtgacctataaaatttcctctgaattcaccagcttcacctattctgttgctcttaactttccatgatacaatctccttctccaatacaatgaattcttcctttgatctgtgcccttaacgctatgtttttgatgcctgattaaagaaattatggcatagctgttctatgtaatattatgcaaggatgctatgaaatcattaaaaatgtttgtctgtatatgctgacatggaaggtcatct

SEQ ID NO: 78390 - DNA, 499 bp, Homo sapiens
cactttggataaaatttcaacataagatttggagacgacaaataaaccaaactatagcactagatctttaaaaatcatttttaaaaaaagtataaagatttttttgagccatccaaaagaaatctggaaaatagttgggtcattgtccttccattagagctggccactcctatgaatgagatgccactggtgacacactctggtggaaagagccctggcttgtgagccaaaagtcaatgttaatacctctgtcagcttgtacaaggcaaccgaactttcagggcctcagttttctgatggatataataaaaagatttagatgggcttattctaaattacctaaatcaatgccttgattatttttaagagttgaagtatctcaaacaaactggcttttgtctcaaaataaatgatcctgaactgaaagaaatcatgcagcaaacctatggcatttcaatgtttttagttttacttttgaggtggtggtatttttttgtcc

SEQ ID NO: 78391 - DNA, 762 bp, Homo sapiens
tgggccctgtgctagataggaggaatataaagtgaaaataataataaaagttaatgtttagtgtttatgtgccacagattgtattaaccattttacatatagtattttgttcagttctcaaaacattcctgtgagatcaggtctatcatcagtattactggccttgtaaaaggaccatttctttgtcttctctgtgcttcctcaaattggcttcctgctcttgacaggttgaccttcagagcagcagtgtaagggaaccattccaggtgctctgttaggaacaatgctgctgtggaagcccctagactgttggctattagatggggtgacttaagacatatcagtagggatagtttttttttctttttttcttaaaaaaataattcagccccatagcaagacttactataaatctccaattattaggacatggtggtattatctcatggatagacaaatagcccaatggaacagaagagtagagaaacaaatgcacatatctctgggtgcttgttatatgacataggtggcactgtaaagtagtgtggctgggtcatttcggctggatgatcatgtgaaaacaaaaaatgactcttgaccctatttcacgccacacacagaaatgacttaaagatggattgtagatctaaatgtaaatattaaaataataaaactgctagaaggtaaaatacaaggatgtctccatgatcttaaggtaggcaaagatttcttaaacaggacacaaaaatccctataaccata

SEQ ID NO: 78392 - DNA, 282 bp, Homo sapiens
gagaaaaacattaaacatcagaaatggtaattatataaggaaatataagactgttctcttgggttttaaaaatgattataatttgatggttgaaatcaacaattacaatatctgttggggtttccaatgtatgcatcgtatgtagatgtaatatgatgaattatttttactcctaacacttctggcactaaatacatgtttttgttttcacaccagcaaccaattctccaactcgctggatgccaactaggtgtccagcaattcaatttaattctgacactg

SEQ ID NO: 78393 - DNA, 891 bp, Homo sapiens
cgggcgccgcctctgcctgggggagccggggctcgctgggggcgacttccttgttcgtatcgagccagcgaaaagacagaaccggaagagaccgggggcgaaggcgacaggggtctgtggaagagacctgtcggcggagagcggtccacgttttcctggagaaagacgaggccccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagctcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaacgctgcctctctgctcgggacgtggattcctttcccctcctcctcgcctggctactgctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagccattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggccggcgcggggaaaggggaaggtcgg

SEQ ID NO: 78394 - DNA, 2625 bp, Homo sapiens
agtttcagtttccatttctgatttctgctctctgcgctgagcacagcggcaccaggctgagctaagcagggccgccttgggcaggcctacgtggtggtgcaggcgagacccaggctgggcaaggcgcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccagagaatccaaaactggagatgctggaaaagatcctgcaaaggcagttcagtagctctaacagccctcggggtatcatcttcacccgcacccgccaaagcgcacactccctcctgctctggctccagcagcagcagggcctgcagactgtggacatccgggcccagctactgattggggctgggaacagcagccagagcacccacatgacccagagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaagatccgggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcgaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaaaaaaaggt

SEQ ID NO: 78395 - DNA, 2572 bp, Homo sapiens
ttcttttctcttggttctttttcctggggcggggatgggagattcctaagtcggctcagctggctccttccctcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccagagaatccaaaactggagatgctggaaaagatcctgcaaaggcagttcagtagctctaacagccctcggggtatcatcttcacccgcacccgccaaagcgcacactccctcctgctctggctccagcagcagcagggcctgcagactgtggacatccgggcccagctactgattggggctgggaacagcagccagagcacccacatgacccagagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaagatccgggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcgaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaaaaaaaggt

SEQ ID NO: 78396 - DNA, 1156 bp, Homo sapiens
ctgcctttaaaaaaaaaaaagcgacaccagttgacctgagtggaagggactgtgaataatgagatttagaaaaagacagactagcccgtggaagatttgaaaggtcaggtgtgaaagtgtagcctttatccaggaggttcctcttaggaatcttggatagattttaaggaacagaatgtcagggcagatttatatttttagatccctctagcagttggtggaaggatggcttgggattgggagtaaaaatggaggcagagagacccataaggagactgtgaagaccaggtaaccgatgctgaggcttgaacctgggcacaagggaacgtgcgatggaggccacacaggtagaactcaccaaagattggatttcctggcctgggaagtctgtgcctcttaaccagcaggaaggcccaaggtccaggcagagacttggccggcaggagggcatgagatccggggctgaggagggtcaatgagggctgtggccaccccccttcctctccaggaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaaaaaaaggt

SEQ ID NO: 78397 - DNA, 1375 bp, Homo sapiens
agggcagggggcggggctgtgggctgctcagaccctgcgccctattcccgcagcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaagatccgggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaaaaaaaggt

SEQ ID NO: 78398 - DNA, 719 bp, Homo sapiens
agggcagggggcggggctgtgggctgctcagaccctgcgccctattcccgcagcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaaaaaaaggt

SEQ ID NO: 78399 - DNA, 2667 bp, Homo sapiens
actgctctggccaggagttgggatgagtggagggcccagtgggtctgagtcccctgccattcccagaatggagctgtggccctaccaatgggaggtgatcatgcctgccagggcgctggcgcagcagcagtacttaaccggagtttgtactcacggcagttggcgatgacttttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccagagaatccaaaactggagatgctggaaaagatcctgcaaaggcagttcagtagctctaacagccctcggggtatcatcttcacccgcacccgccaaagcgcacactccctcctgctctggctccagcagcagcagggcctgcagactgtggacatccgggcccagctactgattggggctgggaacagcagccagagcacccacatgacccagagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaagatccgggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcgaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaaaaaaaggt

SEQ ID NO: 78400 - DNA, 389 bp, Homo sapiens
gttgtgaagggaagaaggaattcttacatcattgtggggactacttgaaagctgatgggaggaagggctttgcaaacataggtcacagccttcccccctgtgccctcagtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcaggtcagcctggcccctgtgggcctcccactgccagacccaccagggacttccctccctccctgcctgccctgccactaccccgtccccac

SEQ ID NO: 78401 - DNA, 340 bp, Homo sapiens
gcaaagcttattttttcagttgtgggctctagtttggttgggaaactatttccttagacctgggtcacccctcgggctcccttaatctcccgccatatgttctccagaatcagggcatggtgttctgccctggtgcgactcagcccggttgctttgcacagactctgggccagggcaggatgtcggtgtttgccgggtgttcgccgggtgttatctgtggcgctcagtatggtgcatagtgtagacacgtgccctaggtggtgtttaattgatctgggtaagactcagccaaggcagggcacagtggctcacgtctataatcccagcactttgggaggct

SEQ ID NO: 78402 - DNA, 637 bp, Homo sapiens
gttttaaaacatttgtatgcaaaaatctcattcaaagcacaaagtcctttaaaatattttaacaataaatgtagctgaatgtctatttcttaacagtttgccaaaagtccctgcaacacccactcctgggcaccccccccccccgcccccaccccgtttcttagtctcttttggatcagcaccatttcactttaccccagtgctgacttacaaccaactgctgttccgttgtgtgtaattaaggagaattattattatctgcatttgatctcacaaagcatccacccgggaaaggttatagacagcagtgtattacagctcttaaaaaacgaatgtatacacttagactatggacccagcctcattttcacatttttttacttcagttccttaggaccagctcaatcgtcaagtggtcgcctgaccacttgaattccattttctgtgcataaatgcactttggggaaattgtctgtttgacccttattgggtagacatgaaaagaagatataattgtcatacttaaaaattatcttcccattatttctatttccagattggtgttggaaattaacaatattttatgaaggaaaaatataagtcagaggggaggtttaatcttagccttttgccaaaa

SEQ ID NO: 78403 - DNA, 261 bp, Homo sapiens
acgggtctcaagcctgaccttgggattggggatcacagatctccccccaaatgggagggaacttctcctaagggctgttggtgctttctaaaccaggttgaagtcagacaagccaccatcttgaagaaacctaccctgccccgtgtgccttatttttaagagttggattcacttcctttccctacagaccccaccagaaacacaaaccacctggttgcctgttgtcattgcggcccaactacatggctgacggggtcagtg

SEQ ID NO: 78404 - DNA, 558 bp, Homo sapiens
ttttttttttttcttgaatatttttgacctgcagttggttgaatctggggatatataatctatggatacagagtgctgactacatatccatattttatctagctatcttataaactgaaaagatttcccaaccttaaaaacatggacactaaaaaaaagcctcatattaattgtgatgttttacaaatcacaacatcagtacctcttatatatttcatctcattttaaatatggtctggtcacacttagggtcctttaaaataatgagatattgtataagaatatgcttaagaatagggatctgtatttgactgacaaagggtaattaaaatctatttctatctctatttaccaaataccctatctttaatgcatttttgtaaatctctggaaatcataatatagtcaaagttttaaaaagaagaccttaggctggacatggtggctcatgcctgtaatcacagcactctgggagggtgaggtgggtggactgtctgagcccagaattgaagaccagtgccggcaacatggcaaaacaccatctctacaaaaaaaaaa

SEQ ID NO: 78405 - DNA, 199 bp, Homo sapiens
ttttttttttttcttgaatatttttgacctgcagttggttgaatctggggatatataatctatggatacagagtgctgactacatatccatattttatctagctatcttataaactgaaaagatttcccaaccttaaaaacatgtccccgtacatcgttagaagcttgaattcgagcagtagtagtagtaggcggccgc

SEQ ID NO: 78406 - DNA, 551 bp, Homo sapiens
ttaggacacctcgtgcaaagctgctgacccccagcacacagaaagatagagcaggccaggtgggatcgcaggctgggcgacctggtggggatcaagacagagctctgagaccaacctgacagctagacttggcagtggctcccgcagccaggtgtctgcctgaaaaaagacaaaagggaaaactttgaaagtcgtaacctcattagaagttgttcaagaaagaccgtgcttagaaccagttgagtagataatggcagcagatgtaattgttgtggatgcttttagagtcccttggagtaatccttcttagtctcttaattccaggcttccagatacggagcctcagtgatgaagagacttgttcttgtccacagcaaaggttggtagaaaagcagatttagaatggagaattcttaacgcctactctagcattcacgtttccctgggaccatgttgtttctctagaggggaggaggattgtggcatctgcattaacacccggtcctgtgggcactcagagaacttaactgctgcatttgtggaacggaata

SEQ ID NO: 78407 - DNA, 765 bp, Homo sapiens
acaaggccttttaccattatataatgcccctctttgtttcttttaactgctgttgctttaaactttgttttgtctgttataagaatagctatccctgctgctcacttttggtgtccatttgcatgaaatgcctttttccacccctttactttaagtttatgggagtccttatgtgttaggtcctgtaggcaacggatagttggttgatgagttcttacccattctgcaattctgtatcttttcagtggaacatttaggccatttacattcaatgttagtattgaaacgtgaggtatctttgcattcatcatgctctttgttgcctgtgtactttgttttttttttggtttttgtttttgctttttagcatgtatttttgttttctagggcctgtgtgatgtatgctttgaagaggttctgctttgatgtgtttccaggatttgttaaaagatttagagctcctttcagcagttgttgtaggggtagcttggtaatggtgaattctctcagcatttgtttttctgaaaacgactgtatctttccttcatatatgatgcttagtttcactgaatacaaatttcctggctgataattgttttgtttgaggaggctgaagatagggccccaattcctcctagcttgtagagtttctgttgagaaatctgctattaatctgatgggttttctcctgtctcacagctcttaagattctttccttcaccttaactttggataacttgatgacaatgtgcctaggttaagatc

SEQ ID NO: 78408 - DNA, 436 bp, Homo sapiens
tcttggattctgtggttgctaggaaaattctgcctgcagtgatattgcgtggtcctagggctcaggcgaaaacagaatgttcctgagaagacgggaaggattcatagggcttcccaagcgagggtgccccatcctaggaagctggacaactcgtgtccctttctagatgcttatttcccttctgagcaatggaggttgtgctggtaaagccagaaccccatgaaggcgagctggcagtgggaggtgacaaggctcattcccttagcagcaccttggttctctagtgccaagtggaaggtgtgtcttgtgcattgcatccttgtagttgggccctccatctctggccctcccgacagctgggtgcgtcctccctctcttggtagagcagttggaaggaggtcagcacatgccggctgtgggggagacccggctcact

SEQ ID NO: 78409 - DNA, 411 bp, Homo sapiens
taaattgaatataaaatttaaaatatgcaatcaatatcaatcattataattgcataatgcaagccatgcttgtgaaatttttattttatattatgccatttggtaagaagattcaccagtctaaattatggtttcttaaattttgtagcacttttggtggcatatttcatgtggtaaaactacttgatgtttcacagaatggagataatattaacatcattaagattccacaagtatattcaaggaagattcttacttttagtattaatatattcaaggaaggttcttacatttctcactaattgtgggaaatgtctcttctctcagtctagtacagtatgtttcgatttctcacctaatgaagacaactttttcagagatggaaagtcaaataaatattcatctaaactc

SEQ ID NO: 78410 - DNA, 362 bp, Homo sapiens
gaaggtcaattccatcacgaggtggatcttttcatcttagccccaccaaaatatcccgaagtctaatatcgaatgggctaattcgcaagaaaaagcagcaacaggtacttaatttcaatctattctttcacctggtttcactaattgttaagaaagaaagaaatgcagatgagtatatagcagcttatggtttgtttctcatttgtttggtgtattaaatgagtatttctgatgcaaatctgtgatgactgcagaatacgaacattacttgaaagaatcttaactaaatgcaatattaaaatgcctccttgggtgactatcttatggggtggttttgtttctgatatcaaaaggctaacaaa

SEQ ID NO: 78411 - DNA, 142 bp, Homo sapiens
cgggtgtggcgccggcgtcctggggaggaggagcagcctctgcccgacccggctcgtgcggaccccaggaccgggcgcgggacgcgtgcgtccagcctccggcgctgcggagacccgcggctgggtccggggaggccccaaa

SEQ ID NO: 78412 - DNA, 322 bp, Homo sapiens
ttgtgtatttctggtgagtgtgggctactggagagattctgagagcttgtgagtttggccaggaggcagcagccaccgtgtagcacgtgtgcactgctgctcaactgctgactcatcccacctgtccaaaaacaatagctgggccatgtgtgtctcggctccatgacaaagggctccagcttccacagggtacctgatatggtttggctctgtgtccccacccaaatctcacctcgaattgtaataatccccacatgtcatgagagggagctggtggaaggtaattgaatcatgggggtgcgtttttcccatgctgttctca

SEQ ID NO: 78413 - DNA, 407 bp, Homo sapiens
aaattaacactggagtacggttgttcctaatttagtgcatcattgagcctcgcgtttcctgctctgtgggtttctgctatgtaaatattgcagtggtaatgcacaatctgtctccactttgtgccagtaacacttaaattaggtgtcgcctgaaggaagattttatgctagttgcagcattgtcagttaattatcttaaaggttatttgcaataataccgtttgcctctttttaagaggataggagggaaagttacatttataaatctatcctagaggtaatctctaaactcagcctgtgacttccagaaggagtaaagttttgatacctataatgcaaaattacttaggagaaagaatattgaaaatttattacagttctgaatattaaacattcccccctgcaaa

SEQ ID NO: 78414 - DNA, 592 bp, Homo sapiens
atgtgcaagggttccagtttcaccacatcctcaccaacacttattttctgtgatttttttaaataatagccatcctaataggtgtgaagtggtatcccactgtgattctgatgtgcgtttctctaatgattattgatgttgaacatctttccatgtgtttattggccatctgcgtatcttgtttggagaaatgtctatccagggccttggtccatttttttagcattttggtttttgtcacttgcatggcttttttcagtaattgctctaggtattacattgcatgtacataacttataagttataatccactggtattgccatttaaccaattccagcaaagcatagaaaccttacttcatgcccctttgccttacccagtttaaaatacttctttcaatattttctctacatacatttagaaccacatcagtgttttaacttttccttcagctatcaggtataatttttttttcttgttgacatggagttttgctcttgttgcccagactagagtgcaatggcgccatctcagctcactgcaacctccgccttccaggttcaagtgattctcctgcctcagcctcctgag

SEQ ID NO: 78415 - DNA, 430 bp, Homo sapiens
tcacatcatacacaaaactcaattctaaataaattgtaagtccccatctaaaaagacaatacatcttctagaagaaatcatagaatatttttgtttattcagggaaggaaaagatggtttaaatgggacagaaaagctaccaatgataaaggatatgattgattaaaatggactacattaacagtttaaaattctgaatttctcatcacagatactaagactaaaaatgcaaggcactgagtagatataaaaagtcagtcaatggatttgtacctagaatatataaagaactaattaataaaaaataggcatctaggctgggcatggtggcttacacctgtaatctcagcactttgggaggctgagcaggaggactgcttgagcccaggagtgtgggaccagcctgggccacacagtgagaccccatctc

SEQ ID NO: 78416 - DNA, 396 bp, Homo sapiens
cacaaaaggcacatgaaggaaaagaaaaagaaaaaaattgctggaaattaatagacagaaagtagactagtcaaagaggatctttcaactcctttacactgtggaagtaggggtttatgtcttgaatttaatgtccccttcatttacatatcttacattttataaaatctgtaataatgcccatgtctacagcctcttttctatgtaatcttagatttttaaaaaagcattgatagttaatttgttttgaaaataatggaccagctctaagctggagagcacagaagcagacagcaatttgttagcctgatatttttctttgtcttcctcttgttttttgaatgatcaaaaattggcacaattttagaaactttataatgaatagttttaaataat

SEQ ID NO: 78417 - DNA, 548 bp, Homo sapiens
ggaagcactcaagggtcatctttaccgtcccggagctggccttggcctgcgttcccactagctgttaaacccaacatgccaaacctggaagaacgctaatacatcaagcattggtgtacagcaggccttcgcttattataacctctaaagagcagtgagcccatttcaggccctctgtgagaggtcacaaggacctctgaatgaaaaaatatcaggattcaaaaaccattctgcagaaatcaacaggctgatcctaaaacgtacatggaaatgcaaaggacctaggatagtcaaaacccaacattattttgaaaaagaggaacaaaaatggagactgtacactacccaatttcaaaacttatcataaagttacaagtaaccacaatagcaacagacacataaatcaatggaacagaattgaaagccgagaaataaaccactacatttatgaccagttgattctgccaagggaattcaggaagaaaggatggtcttttcaacaaatgatgttgctacaactagaaatatgtgtgtttacaaaaaaaaaa

SEQ ID NO: 78418 - DNA, 534 bp, Homo sapiens
agggcagaattctagccagaagggggcgagggttacccagcccagtggagcatggagccgcccctctagttcccactgccaccgtgatgccatcagatgggagaaaacacagaactcgggatgaaacgtcacacggtctgggctaaagatcttgctctttaatttcccagcaggtaaccttgtggcagtcactaaccctctctacacctcaatgttctcatctgtaaaatggaaatgatgaccccttcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaacc

SEQ ID NO: 78419 - DNA, 5018 bp, Homo sapiens
  misc_feature (44)..(44): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaacc

SEQ ID NO: 78420 - DNA, 4110 bp, Homo sapiens
  misc_feature (44)..(44): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggctcccctctggaatgcactgaataaagcacgtgcaaggactcccgga

SEQ ID NO: 78421 - DNA, 3391 bp, Homo sapiens
cctccatcttctcactccattctcccacagcagccagggcagccttcagcatgcaggtctgtcaggacattccctgcctgaggcattcggcgactcctaccagttgcaaggaatgaccccaaggccctgtcacaggcccctgaccatctcttcctctctcccacccctgtgtctcttaccacagcaacactgacccacctatcatttcccagactcaccgtcccgctcctgccccagggcccctgcatcaggccgtccttcctcctggacttcaccacctccatcccggtccacacagctaccttgaccgtccttcagaactctgatcccctgtcacttcctcgggcttccctgacttcctacaggccggtttttttgcacattttacactagtgatttgttcatacaccaatcttccccttgagctgagggcagaagctgcatctttcttgttttgtatccccagtacaaaagcccttgcccacacacagtagatgatcaataaatgttgaccagaaccgctctgctgggtgagtgggggtgggggttctgtgccatcagctcagttatgaactgaaggggagccaggaggagctgagctttgagcatcgttttaaagagggaagcatctatggaaaagcacaagacagagcagtgtggtgtctggggacagtgcaggaaagccagcccatgtctagtgtggtggagacagagctggtgtacattgagggcgaggggctgcgggtccctacccagctgcccacacctggctctccctggcccaggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaacc

SEQ ID NO: 78422 - DNA, 2806 bp, Homo sapiens
  misc_feature (44)..(44): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggagaaggggtgtgtaccaggctatgatttctcttgcattaaaatgtattattatttaaa

SEQ ID NO: 78423 - DNA, 2551 bp, Homo sapiens
  misc_feature (44)..(44): n is a, c, g, or t
  misc_feature (2511)..(2511): n is a, c, g, or t
  misc_feature (2525)..(2525): n is a, c, g, or t
  misc_feature (2531)..(2532): n is a, c, g, or t
  misc_feature (2534)..(2535): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccanagggtgctgaggancatacnntnncgcgcttataggacgc

SEQ ID NO: 78424 - DNA, 1103 bp, Homo sapiens
cctccatcttctcactccattctcccacagcagccagggcagccttcagcatgcaggtctgtcaggacattccctgcctgaggcattcggcgactcctaccagttgcaaggaatgaccccaaggccctgtcacaggcccctgaccatctcttcctctctcccacccctgtgtctcttaccacagcaacactgacccacctatcatttcccagactcaccgtcccgctcctgccccagggcccctgcatcaggccgtccttcctcctggacttcaccacctccatcccggtccacacagctaccttgaccgtccttcagaactctgatcccctgtcacttcctcgggcttccctgacttcctacaggccggtttttttgcacattttacactagtgatttgttcatacaccaatcttccccttgagctgagggcagaagctgcatctttcttgttttgtatccccagtacaaaagcccttgcccacacacagtagatgatcaataaatgttgaccagaaccgctctgctgggtgagtgggggtgggggttctgtgccatcagctcagttatgaactgaaggggagccaggaggagctgagctttgagcatcgttttaaagagggaagcatctatggaaaagcacaagacagagcagtgtggtgtctggggacagtgcaggaaagccagcccatgtctagtgtggtggagacagagctggtgtacattgagggcgaggggctgcgggtccctacccagctgcccacacctggctctccctggcccaggtgcccttctggaacggctgcaatgaggatgagcactgtgtccctgaccttgtgttggatgcccggagtgacctgcccacggccatgtgagttggctccttccacccccaccctcgccccttccccttcactgccagaggctctggggctcctggggccctggattatttcctggacatcctcctcacaggcagcatggatcaaacattgcacttggagcctgcgttctagcccaggctctgccaccaactcctgcataacctcaggaaagtctcttctgtaatatgaaactactagtctaatctaatttcaaatttt

SEQ ID NO: 78425 - DNA, 4986 bp, Homo sapiens
  misc_feature (44)..(44): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaacc

SEQ ID NO: 78426 - DNA, 4744 bp, Homo sapiens
  misc_feature (44)..(44): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacactgcctcccatccttccctcatgcccgccagtgcacagggaagggcttggccagcgctgttgaggggtcccctctggaatgcactgaataaagcacgtgcaaggactcccgga

SEQ ID NO: 78427 - DNA, 4702 bp, Homo sapiens
actcacttcctttccttcggtggcctccaggatgatctggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaacc

SEQ ID NO: 78428 - DNA, 3722 bp, Homo sapiens
  misc_feature (44)..(44): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagctcaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaaggtgagggccctggcaggggagggaaggagcagcatcctggctgggcgcaacgggtctctgaccctgtatcagtgagagcgctcactcagggtcctatgcaagctatagggctctcctcgcttggtctgacgggtctt

SEQ ID NO: 78429 - DNA, 1172 bp, Homo sapiens
  misc_feature (44)..(44): n is a, c, g, or t
ggcacgaggccgcgccgaggaggctgccgctctggcttgccagncccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaactttttcaggatgttgatgaggaagtgctgaacctccacccaggggtagatgctgttggagccatccaggacaatgacgatgtcatgtaggtctggcacctttggagagctggggccacggtcttggagacctgaagatcggagttga

SEQ ID NO: 78430 - DNA, 867 bp, Homo sapiens
ctgaattatcagatgacagtgaagaaagcctagaaaaaacagtttacacatttgaaactccgaaaggctcagcaattagcagttgtgtgtatctctagaatgggcaggagggaagaagaaggttatagttataggtacaggcgaagctctacatataaaaactatatgaaaatgggaaatgtttattaaacattcattaaacatacaaagtctgttcaattagttagattcctcagtctcctccacttaacacagacaggtaacagtgcctcatttatccctttatccagaagaagactgaaagtcagacctttggggatgtacagttcaatcacattggtgtacggtcatcaccaccatccatctccagaattcttttcatctttcaaaactaaaagtctatgcacattaaacaataatgcctcatgaccactttcccctggcccttggtgacccaccattttacttcctgtctctatgattttgactactgtaagtacctcgtatatgtgagatcatacagtatttgtctttttgttactggattgtttcactcagtatcatgtccttgaagtttcatgcatgttgtagcatgtgccagaatgtcctttcgttttaaggctgaatgatactcctgtgtgtgtgtgtatgccatattttatttactcattcatctgtggatggactcttgggttgcttttgcctcttcactatcgtgatatcgacattttaaagtgatatttttattttgtttattaaacatagattaaattttgctgtaccacatgtaaatattaaagattgctttcgtttgctgatgtttgaagttctttcaatgtcaacaaataaactggtttgtttttgtaa

SEQ ID NO: 78431 - DNA, 420 bp, Homo sapiens
cttactgacacatttttatttgtaatgtaaactggacaggcctataaatgacaaaggaaaaaatgcatatattgaagaacagggatgaattacaaatttatgaatttaggtaattttaaaaaatttttagtgggatcatttaggacagcagttctgtaagtgtgtttcatgtaactatggggatctttgagatccatttagaaggttcatgtattagtcagtgttctctagaggagatttttttacggagaataggtttacacaatgatagatggagacagtaaagacccacaatcggctgtctgcaatctgaaaacccaagaaagccagtggtataattcagtctacatctgaagacctgagaaccaggggagcctatggtgtaaatcatagtctgagggcaggagaagatgagatgag

SEQ ID NO: 78432 - DNA, 584 bp, Homo sapiens
tcctaagtccttttaccttgaatctgtcatgtacataggacaaactatagtattggtaaaagggagattggaaacattttgatttgcaattgaggggaggagctgttatggtcttgacctcattttctttatcagcatgcttcctgttaataaaaagaatgggaaataacagaagtggatattctttggcttaaaagatgtattaatatttattcagatttccttaatatatcactgacagaatacttttaattactgagaactaaatgttgttttgggtctgcccttctccacaaattcctaaccatccctgaaaagtttctggaatctccttctgcctttggtagctggggaaggagaaattcacgagactgacagaattcagcccagtagcctctgccagagctgacaggcttgatggtcgcctttcggtcttcttttttttttttttcataatgcgtgtgcctttcttcattggtggtctcctgaagtcaccagccctgccagaagctctttcactgggacaaaaggggaactggagcgagatggcctctcatatgttggcaactctccctgaattttct

SEQ ID NO: 78433 - DNA, 636 bp, Homo sapiens
gaacactgaaccccactcatgggcctggtacctttctatacaagttatcctatttaatctccacaacaagcctactagatgctgagatctcaatgtgcaaataccccagaacagcacctagatgaggcacagggactcactggaagccttgtcttccttgggcccatctgtgaggagcagaacagctcacctcttgcctgacaggctagtcctgggtaatgcatccagcctacctcttgttgccaccctaccccaccgtcagtgccacatacccgtgaacacaaacccactggggctgagcggctgtgccactgtcacaggatccttagggtgtcacttcaccagctggagacttctgtggccagtggcggctttacctgagttttgcttgggcccactgggctccttccacccacttggcctggcaggctgtgcttgtctttcactactggtccagatcccatgcctgccaagggcaagccaggtgcagagcagcaagggttgcatgagcaaatgagtgtggggtctggccattgggcacagccaggcatgccagctgtggcagggcaggcagctccaggcacaggcgctggttacctgctgtggctgtggctagaccaagcgtactgcaagcag

SEQ ID NO: 78434 - DNA, 793 bp, Homo sapiens
taaactaaaaaaaataaaatctctggcgtggcatagtggctcacgcctgtactcccaaaatactgggattacaggcatgagccaccgtggcccgcccaattttgagtttttatgttctaatcccaaacatctgctcacaggcccctcagcatattctttcctgggtccagtgtcacctcccaggcctgcaggctggctagagcagtagggtgtgtgggaaagctctgggctttgcaggcactgatcagctgtgtgaccttaaccaccctgaacctcagtttcctcacctgtaatggaaataggtaccacggcagtttgttgcaaggactagagagtaaccttgggaataaaaggtagcagcagcttgggctctggagatggactgtccaagaccaacttccagttcctccccacacaagctctggcacttagattcctggtacctccgctgcttcatctgtaaaatggagtaacaataggaatactttatagagttgtaaggattgagtggctggatgaacgtcaagcacttcaaaggggacctggcatgtagtgagtgatcaatataaaccacctggcttgtagcaggtgtgctgtgtgtggctgcaggtgttattagtaacatctgtgtgcccttcagagcgtgcaccacacttcacaccttgtggagtctggaatgccactattatagttcaggatagaaaacctccctgcaagcactcgctttagcttgtctccactgaacaaaacaacacaagttctttattacttggaatgggaaaacttcaaaggc

SEQ ID NO: 78435 - DNA, 707 bp, Homo sapiens
  misc_feature (702)..(704): n is a, c, g, or t
ggcgcatgttatggtcacctctgtgaggattacatcaggaaggacagtctccaaaagacatggacagaggaaatttagcagatgtccattaaatcaggatctcatacaagttataacacctgaatgtttgacttttcagagtattttgccatcacaggtgtggcatcttgcccttggatatatctacattctgctgtagaatgtcgtggtctttctgagggtcacatacatcctgtcttgtcataatgttaaccattaagagtcctcaggggcatggaattgaagaaggaactgttgccagcagttaactgaccaagctagagttccctgacccaacgtaagggtgactgtgacacacatggataattttagcttcatgtttaagattttgttatttgggtaggaaacattccaaatgcagtttgaaacacatattaaaattgaggcacacaggaaagaactggctcaagtttagtccccaagttccttatagtaggaataggaatccttagagtataagcaatccatgcatagtattctgttatctatcatgtagatcatttaatctctaattttttggggtggggattctcttgtttctaaatcttacactttcagtttcttctgtgtcttaaatatagattattgactgttgtcttaaatactaataaatacattaaatgtatcttaaatactaaaaannnaaa

SEQ ID NO: 78436 - DNA, 745 bp, Homo sapiens
ctcctaccgcctactccagtcctctccaccccaaggtaggcagcttcccgctcctcgtcttgggacctaaacccaggaagtcaaatgtccttttctagcaggtcgcctggttagaggccgtggacgaagcggtccaggcacagccagctgcagggcgcggcctcggcggcgctgctcgtggccctggtcagtgagcgcactcactcctggactaaggtaacccgcgtggaggagacccagctcccagctctatgcaactcattttcatctagcattacctctccaaaacctgaatctccacaagaaagccacacagcaattaaccagtgttgcaagaactgcttctgtaataaaggtgggaagacaaattgatgcaaccctcttgaaaagcaatctggcaatatgaaccaagagccatgaaaaggcttatgctattataattaaatggctgtaatgttggctgtaaatatgaaattttctttcacacaccaatgttttcaagaatggcatattcacatgcagtatgtgatgaaagaagcagtaaaggatgctaacaaagctatttctttggacaatctgaacctgacggagtcttactctgtcgcccaggcaggagtgcaatggcacaatcttggctcaccacaacctccgcctcctgggttcaagtgactctcctgcctggccatagaagcaaacacaaacatagaggaattggctttgggcagatggaaggacctcagagaaa

SEQ ID NO: 78437 - DNA, 256 bp, Homo sapiens
cccaaaccctgagacaccatacaagcgcacaccagcaatcacccagtggcctagggaacggacctctctgaatgagcaatcagggcaaactgaggatccgtcccgtcttccgttgcataggttctctacccaaaggcaacgtttcttgaagagcaagaaacacttggggtaggtcctgtaaaaggaaacaaaccgaactccccaaagacaggcactttgcaaacagagaaactaagcgtaacttccaattatacaa

SEQ ID NO: 78438 - DNA, 316 bp, Homo sapiens
aggtaagtggggtctcatagactggaagtcccagaactgaaagtcaaggagttgggagctcatgcaactggcaatggagaaccaccaaaaggtgaactgttatgcttgtgattattttcttcatggtttctttggggtcctgggagtgtgtggtggctgttatgtgtaactgtgattaactttacatcgtgaaaagtcagtcaccaaaaggcagaagaggctagatgggactcgcctgcagaactggaccgagggctctgcggctgccaccgaatctgctccaggatcctgcccagtctcctcccacgcagggtaa

SEQ ID NO: 78439 - DNA, 441 bp, Homo sapiens
ggattacaggcatggccaccacacctgactaattttgtatttttagtagagacggggtttctccattttggtaaagctggtttcgaattcccgatctcaggtaatctgcctgcctcggcctcccaaagtgctgggattacaggtgtaagccaccacgctgggctaaattttatataattttcatgtgctagaaaatactattctttttttaatttttttcaaacatataaaaatgtaaaaatcttcttagcttacaggatgtacaaaaatagtggactggatttggccttcagatagtggatggctaacccctggtttagaggggcaagcactgtactgagaggcagaggacagattccgctttcccttacactactattaactgtgacctacggtgcctcacctctaccaaaagaaagtcacttaatttttctgagccta

SEQ ID NO: 78440 - DNA, 447 bp, Homo sapiens
cttattggcccatttcaaggattttgactttgattcatatgatgtgggaaggccttggagaattttccgaggggactatactatctgatgtatgtttcagtatgaaatagaatctctctggctgctatgatctgaaggaggacaagggagcagggattccacgggggcattgattgcacagagccaggtaagagtgatgatgcttggaccaaagtggtggcactgggtggagggtcagaaccgacaagatttgctctcggattagatgtgggatatgggggtgtgagaggggccaagtgtgactctcaggttttcgaactgaataactggaagaatagagttgccttttattgaaatgaaggtcgaggctgcagtggtaagctgtgattgcgccactgcactccagcctgggcaacagagcaagaccctgtctcaaaaaaaaaaaaa

SEQ ID NO: 78441 - DNA, 975 bp, Homo sapiens
aagtcaagggccggctggcaaccgccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaaggtcaaaaaaaaaaaaaagaacagaacagaaagacagaagaaaagcaagagaacaaaaaaaacagagggacagatagaaagcacgagagaagagaacgacaagataaaaacaaggagcagaaaagagaagcgagcaggacaaagcacgggaaggaggaagagaagaaagaggagaaggacacaaaagagagaaaagacgagacaagagggaagagaacagacaaaggacagaacaaaaagagaaagaaagaaagcgccccca

SEQ ID NO: 78442 - DNA, 329 bp, Homo sapiens
  misc_feature (20)..(20): n is a, c, g, or t
  misc_feature (29)..(29): n is a, c, g, or t
  misc_feature (50)..(50): n is a, c, g, or t
  misc_feature (56)..(56): n is a, c, g, or t
ctacatcgacccggaggaanctggctganattttcagggcctccggggancacgtnactgatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaaggtc

SEQ ID NO: 78443 - DNA, 1038 bp, Homo sapiens
cagtggccaccctggtcaggttaccgtgggtggcttgcctgcctccacactggttttattatcccaacttgagggacagctgtccttcgggccacccagcttgagtttcatcaggggccgaaagggcattgagtggtcactgactattgttactgagggtcaccttggtcctgaagggggtgcccacctgtcaccctggccctgagcccagtcgcagtgaggccagctgggtcacgtcagggctttgggggcagggagggaggactgagacctccactctgtggcctggaaatagcctgcctcctccagctccagccttctcacctgtggaatgggttggtttcctcagcagcagctatacctgagtctgagccttgagattccctttcctttctaggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaaggtc

SEQ ID NO: 78444 - DNA, 623 bp, Homo sapiens
aagtcaagggccggctggcaaccgccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagctccccagatctgtcctgggggatgcaaataaagcctgctctcccaaggtc

SEQ ID NO: 78445 - DNA, 599 bp, Homo sapiens
aagtcaagggccggctggcaaccgccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacgaacttccgagaagtcaccaccaatcaagagctgattcagaagagcagagggactcagtgaagttccagaactggcctgatagcagccactacatgattaagaaaaaaacaagcggctttgttgtaaaaaagattggcttcatggtttctataatcgtgaatttctcctccatgttccaattgtcacctgatttttaatccaagagtatcaaacttgatgtacccctttgtttaactgaaggttgctttctcacttggtatccctttctttcaaaatttaactttcaggaaataaaggtaaccagtttgctatgaatgttaacacatagccttctgggcccaatta

SEQ ID NO: 78446 - DNA, 307 bp, Homo sapiens
aagtcaagggccggctggcaaccgccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcctccaactccagctgagtcctggggttggggagggggtcggggtcccaggacctgagcctggccatgtcctcaaccccaaatcccccgactccctccccagatctgtcctgggggatgcaaataaagcctgctctcccaaggtc

SEQ ID NO: 78447 - DNA, 717 bp, Homo sapiens
aagtcaagggccggctggcaaccgccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaaggtc

SEQ ID NO: 78448 - DNA, 517 bp, Homo sapiens
cagtggccaccctggtcaggttaccgtgggtggcttgcctgcctccacactggttttattatcccaacttgagggacagctgtccttcgggccacccagcttgagtttcatcaggggccgaaagggcattgagtggtcactgactattgttactgagggtcaccttggtcctgaagggggtgcccacctgtcaccctggccctgagcccagtcgcagtgaggccagctgggtcacgtcagggctttgggggcagggagggaggactgagacctccactctgtggcctggaaatagcctgcctcctccagctccagccttctcacctgtggaatgggttggtttcctcagcagcagctatacctgagtctgagccttgagattccctttcctttctaggtagagcagctgacagaagagcagaaaaatggtgagacttcccagaccccggaggcgtggaggagaggagactgtttgatgtggtacaggggcagtcagtggagggcgagtggtttcgga

SEQ ID NO: 78449 - DNA, 583 bp, Homo sapiens
aagtcaagggccggctggcaaccgccagcaagctgtcctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagctcatggagctcatgaaggttctggagtaagggttgatcctagtcacagacgctacagatgcacgacggctaaca

SEQ ID NO: 78450 - DNA, 1011 bp, Homo sapiens
gcctactagatatttaatgtaatcaccatgataatggctaagatttattaagcatctgctatgtgctttatggtgctaagaacttctcatgtatttactcattgaatcttcacaaaaaccttatgaagacggctctctcaaatgttactgtctatatgaatccaccttgggatattagtaaaatgagtttctgatacagaagatctagaaagcgcctgaaatgctgatattctgtctcccaggtggaggagttcagctattaccttgactttgccgaagtcctaggcactcccatgccctcagagtctcattttgaatccaggcacttagggatgctatttttccacatcaaacagcttcctcccagccaaagaattctggtgacagtagtgaagataattttcactcctgcttacagaatgacaaagcaaaagcaaagaggagaagaatgaagtaaagacaaccaaaggaaaagactgatggctccttaagaatgatcttgataaaggaatggtggctgaggggtccatctcctaaaccacccaccttactgactccctagagcaatgccatacagaaagctgcaccttgaggggaagacacaagaatcctggagtggaaaaaaattgggtaatgatgacagccttcgaggtcttgagagtaaagcagaagcaaaaaaaaagtgttatttttatcttttgaagatggttccctcttaagacttttgcgaatgattaagatttcaattatgttccaggaaaaaaataagatttttgcttgacaaaaaaaatttttgtctagaacaggtgggaaggaagagatagtttagccacatccaagagacctgtaaattgggtacagtgaagtgaatggtgtaccagtcataaaagaatgttaactggagaagtctctgctgtcttcctgtaactgaggggggtgtaaccatccttgtggaagcgtccacttttattgaagattggctaaataaatctgtgcctactgaaactcaaa

SEQ ID NO: 78451 - DNA, 618 bp, Homo sapiens
ccatacgcttcaaggcgttccaaatatccgcttggaaatactacaaaaacagtgtttcaaaactgctctatcaaaaggaaggatccacactgtgagttgaattcacacatcacaaagaagtctctgagaattcttctgtctgggtttataggaagaaatcccgtttccaacgaaggcctcaaagaggtccaaatatccacttgcagattctacagaaacaatgtttccaaactgctctatcaagaggaatgttgcactcggtgagttgaatgcacacatcacaaagtagtttctgagattgcttctgtctaccttttatggaaagatattcccttttctaccataggcctgaaagcgctctcaatgtacccttgcaaattctacaaaaagagtgtttccaaattgctctatcaagagaaatctttatctcggtgagttgaaagcacacatcacaaagaagactctgagaattcttctgtctgggtttataagatgcccgtttccaacgaaggcctcaaggaggtccaaatacaaacaagctgattctacagaaagagtgtttccctgctctctcaagaggaatgttccactcggtgagttgtgcagacatcacagagg

SEQ ID NO: 78452 - DNA, 497 bp, Homo sapiens
caaactttttacaatctcctatcagtttgctcaatgctactgatgattgtttctatgaggaagctttctaaaaaaacaaacaaacaaaaaaactttctttttttgtacttttgcattgcttagattcctcaaaaaagtgtgcactttttttttcaaaacaatgattttctgaggagaaggaggagaaagagaggcataaggagaggaaaagaagaaagcaaggcaaaggcagaggagaaggaaatacagaagattctgggacacatttctgctcagattttatgtcccattggacacttcttggccaaaacaaagctagcctcatgcaggagaagctgaatgtcaggcagaaccagctggtggcttctctgtcccttcatatgctcatgtgtggctgccacatgaatcctgaggaatctgcctcactcaaagggagtgttggcatgggggagtgttgatatatattttttggattaaaaaaactatgctgaatttta

SEQ ID NO: 78453 - DNA, 413 bp, Homo sapiens
gaatctagacggagcagctcttggagttccagagtagaacactttgaatctggctgggggaaaaagattaagttagaattaaccttcagcttttttcattgatttcagatttactgcaaacctttccagttattgttttctttgtttgaacttagcgtttcaatgtgtaagtaatttgtaaactaggaactgaaattgatttcaattttatatttttatgattcaaacttaaatgaaagattattctaaaaatcaagagagtgaataacatgaaaaaatttaaaaattatctcaatactaatttttaaaaattgaggatatgaggcaagttgagtagaatccaatgttttctaaataatccttctaactaaagccttcccatgatatcgttacttgcctcttttttgctttta

SEQ ID NO: 78454 - DNA, 1885 bp, Homo sapiens
  misc_feature (1324)..(1324): n is a, c, g, or t
atgctataatgtctgaacagccactgcacttgggcaacatagcaagaccctgtctcttaaaaaaacagtctccatttatatagcattcaggaataggaaaaactacagggaaggcaaacacatcaatggcctcctgagctgggaatgggagttaattacaaagggacatgagggaatttttaggggtggtgtgacttcaatatcttgactgctgatgattgattgattacatgtttgacagaactcacagaactctacacttacgaaggaaaaaaagttttgtttttctagcttaaccaaagtggtaccaaacctttaaaatatcaagcttagaagaagggctagaacatgtccatattttacctcattagaaataaagaataggatgttgaaaatggtttgtgctttaagaagactgaaccaagctagtagctcggatttgggtgtccaccacctcaccttccaggcttataactggtaattctgctcaagaatctgtcctcagtgttttcaacatcgagaattaatttgagacaaactacatctagttcataaacaaagctagaattaaaaaggattcctgtcacaggccaaaactagtctacaaaccctcagggtggccaattcttgcttttaacaacagccaaagatattaaagaattccatgaatacagagatggatttttaaaaatacaagtatatataatactaaaaccctcaggaaagccaacatcttgaggtactctggctccagaagaatccatttctgtgggccatattccaagatctaagaggtgtatctgtttgactttactgagtggcttttcacctgacagaccagacaaacttaaaagctttcaagtcaaactttggtaggcaaaggtaaagtatgtcttttgttttagagtaggtgagcctgcaggtcaatttgtcaaaaatattaactaaccacaactatgagacactacacacagtgtagttcctgccttcatggggctcagttctgttcactggagtgggttttatatatacccaataaatagaagtgtgactggcctgtccaatctcgaagtcagaaaagggccatgggtagcatcacatccttagagactggatgcagtcaccagactttgaggaaagagggaaattcatcccaacctgtcatgctagctaagagagcaaaaagtcaagaatatgaacaatgtgacctaggctctgaaagctgaccaagacaccatctaaataaacctggactgacaatgaaaggactttcgttctcccttaaaataatgttcaaaatagcaaggaaatagagcttcagatntgtcttgtgtcacctggtctttcatgtgacagtcaaagatccacaatgtgaaagtgggattaacccatctgtgaagttctagtctgtgcagtcacaattgaccactgcaggttttaacaagaggaccctgtggggacacaacagacttcaattctttagccagcttttccttggctcagaatatggagagagctggaggccctccaaaccagaggatgttcgctggtcttcccaggagagaaatgaactatcttttgtaaaagtaagtttcaaaggccaagtgtagtggctcatgcctgtaatcccagcactttgggaggccaaggcaggtggataacttgaggtcaggagttcaaaaccagcttggcaaacatggtgagatcctgtgtctactaaaaatacaaaaaaaaattagccaggcatactggtacatgcctgtaatcccagctacttgggaagctgaggtatgagaactgcttgaatccaagaggcggaggttgcagtgagccgagatcgagccactacgctccagcctgggtgacagagtgagactctgcctca

SEQ ID NO: 78455 - DNA, 2158 bp, Homo sapiens
  misc_feature (1597)..(1597): n is a, c, g, or t
ctggaggaactgcaaaggtgcacaggcagtttaaaaaacaatccatccattttctaataatctgtgacaaagcaatcccattcgtaggtatttacccaagtgaaggaacatattcacacaaacctgtatgtgaatatagcaactttattcataatcaccaaaaactgaattcagtgaagtagccttccacctggtgaatgaataaatttgtacatccatggcaatgcaatacttcttgggaataaaataatgaactactgataatatggataagtctcaagcatcatgctaaataaaaagccagactcaaaagcctccattagctgggcatagtggcatgcacttgtagtcccagctactcaggaataggaaaaactacagggaaggcaaacacatcaatggcctcctgagctgggaatgggagttaattacaaagggacatgagggaatttttaggggtggtgtgacttcaatatcttgactgctgatgattgattgattacatgtttgacagaactcacagaactctacacttacgaaggaaaaaaagttttgtttttctagcttaaccaaagtggtaccaaacctttaaaatatcaagcttagaagaagggctagaacatgtccatattttacctcattagaaataaagaataggatgttgaaaatggtttgtgctttaagaagactgaaccaagctagtagctcggatttgggtgtccaccacctcaccttccaggcttataactggtaattctgctcaagaatctgtcctcagtgttttcaacatcgagaattaatttgagacaaactacatctagttcataaacaaagctagaattaaaaaggattcctgtcacaggccaaaactagtctacaaaccctcagggtggccaattcttgcttttaacaacagccaaagatattaaagaattccatgaatacagagatggatttttaaaaatacaagtatatataatactaaaaccctcaggaaagccaacatcttgaggtactctggctccagaagaatccatttctgtgggccatattccaagatctaagaggtgtatctgtttgactttactgagtggcttttcacctgacagaccagacaaacttaaaagctttcaagtcaaactttggtaggcaaaggtaaagtatgtcttttgttttagagtaggtgagcctgcaggtcaatttgtcaaaaatattaactaaccacaactatgagacactacacacagtgtagttcctgccttcatggggctcagttctgttcactggagtgggttttatatatacccaataaatagaagtgtgactggcctgtccaatctcgaagtcagaaaagggccatgggtagcatcacatccttagagactggatgcagtcaccagactttgaggaaagagggaaattcatcccaacctgtcatgctagctaagagagcaaaaagtcaagaatatgaacaatgtgacctaggctctgaaagctgaccaagacaccatctaaataaacctggactgacaatgaaaggactttcgttctcccttaaaataatgttcaaaatagcaaggaaatagagcttcagatntgtcttgtgtcacctggtctttcatgtgacagtcaaagatccacaatgtgaaagtgggattaacccatctgtgaagttctagtctgtgcagtcacaattgaccactgcaggttttaacaagaggaccctgtggggacacaacagacttcaattctttagccagcttttccttggctcagaatatggagagagctggaggccctccaaaccagaggatgttcgctggtcttcccaggagagaaatgaactatcttttgtaaaagtaagtttcaaaggccaagtgtagtggctcatgcctgtaatcccagcactttgggaggccaaggcaggtggataacttgaggtcaggagttcaaaaccagcttggcaaacatggtgagatcctgtgtctactaaaaatacaaaaaaaaattagccaggcatactggtacatgcctgtaatcccagctacttgggaagctgaggtatgagaactgcttgaatccaagaggcggaggttgcagtgagccgagatcgagccactacgctccagcctgggtgacagagtgagactctgcctca

SEQ ID NO: 78456 - DNA, 313 bp, Homo sapiens
ccgactctactgaaaatacaaaattagccgggcgtggtgacgcatgcctgtaatcccagctactcgggaggctgaggcaggagaattgcttgaacccgggaggtggaggtttgcagtgatcacaccactgcactctagcctgggtgacaagagcaaaactctgtctcaaaaaaaaaaaaaaagattaaatgaggtcatgagggtgagaccctgatccaagctcataagtgtccttagaagaaggacacttcttctaagtgtccttagaagtgtccttagaagtgtcctaagttggggagcttgctctccccaa

SEQ ID NO: 78457 - DNA, 291 bp, Homo sapiens
ttcctggcgctcagcaatttggcaatcttgaagaaccggctgaaatcaagatgaaattatctgcccacaggtttaaaaatgtagcaatacatgatggggtaaattatgcctaacttagacaagtatagcgataaattttacatgtggcctgaggctgatagaactgtgacgcctgagagttacaggatttgagggctggagttacttccgattcatcttaactgttcttaatgcatcattgtttattttttctttttttaagagaaaaaaaagtcacccaggctggagtgc

SEQ ID NO: 78458 - DNA, 385 bp, Homo sapiens
ggtacctcagatggaaatgctgaaatcacccgtcttctgcgtcgctcaggctgggagctgtagaccggagctgttcctattcggccatcttgtctcctccccccagcccacaacagcctatgaagaataactagaggtcttcatatcagaggcagaaggtactgcaagcttactttccaacgtggctgcatcgtttcacattcccaccagcagtatgaggtttccaatttctctgcatcctcatcaaaacttgttattatctgtcttttttattttagacgttctagaaggtgtggagtggtatctcattgtggtattgatttgcatttccttaaggactaatgcttttgcaacattttttcatgtgcttattgggccatttgta

SEQ ID NO: 78459 - DNA, 655 bp, Homo sapiens
tcacccacaaacccccttcaccttcaaaccccctccttaggcaacctggtggtcccccgctcccgggaggtcaccatattgatgccgaacttagtgcggacacccgatcggcatagcgcactacagcccagaactcctgggctcaagcgatcctcccacctcagcctacagagtttctgggactatagggatgcaccaccatgtctggctatttttttaaaaacttttttttttgtagagatagggggtgtcaccatttaacccaggctggtcttggactcctggccttaagcaatccttccatctgggactcccaaagtgctgagattattacaggcatgagccaccatgcctagccttaggaataagtcttttatgtgtctttatttagctccggtgtccccagctttagctcagccctcctgagggagtgggtattcttttgaatggtcaaaggaaaaagaagatatcaataaaactgtgacaaaaagataagcaatttgggcctgtaggaagtttgtgaacatggaagacagataaccaactagaacactcccgacatctttataactgcagtctgcagaaggaaaaaggcgtgaggtaagagttggaagaaagttctgatccatccagaaattagaatttgtactttacc

SEQ ID NO: 78460 - DNA, 308 bp, Homo sapiens
tacccatggaggctgccatgctgaagtggccgcagagaggtgctctgagcaaccgtcccagctgagcccagccttccagccatccctgccaatgtgtcagacacaggactaaaaagaacaccttagaaggggatcctccagccaccgcctcatatactagagtcaccctcagctctggggcttctggctgagaccctagacatcatgaagtagaaaagcctttcttgttgtgccttgcccaaagtcctgacccacagaagccaggattctctcttttttaaaaattggtaataaataatcattatttt

SEQ ID NO: 78461 - DNA, 507 bp, Homo sapiens
tttttttgcactagtgtctttttatctatgtcctttccagccaaggtggccagtagtttgagccaaaggaaggtacaggggcattcttttaccaacagggaacttggtttccttgagggccacagacaccataacagaccttgaaatgcaggcaccagtcagtgaatggaaagcaactctctgtacttgaaacatctggtcactgcatgtcctgtagataaaacatctgggagattgactgagtgccttagtttctgtccagatgttctttagacacagaccattacatgaaatcattagttgctcttggcaacacgcccaggagttctgaatcaggcatattcctacagggactgtctgtaaagagtttgaagggtgtttccatgaagatgatttacggagtttcagaaaggagtaacagagacacagttctgccaccaaccctgtatccctagactcaagatcagtagcatcttgcttaaaccaaagtgtatagtagagacctgt

SEQ ID NO: 78462 - DNA, 569 bp, Homo sapiens
cgcgttcgccaaactgtgaccccagaccttggccccgccacacagaaacccctgacccagactgtgacatccgactcctaaaatggtcatccgactccagactgtgacccctgaccccaaactgtgacccgaaccccagactgtgccccgaccagactgtgacccttgacatcaaaccgtgacaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtgatgacccagcagacctccaaaaagcctcctctgcccagatctccagccgggtctggggctgggttgcggaggggagggtctgggagtccacacttctccaccaacttcccttcccactctcttattccacattgcagtgtttggaataaaccatgtttttatgcctcctcaaaaaaaaac

SEQ ID NO: 78463 - DNA, 369 bp, Homo sapiens
gttcatacattgacatattccccttcaatatacgtcttgttggcacagatactgactttttcacactgttaactttaaaccctatcagaggctgggcgcggtggctcacgcctgtaatcccagcactttgggaggccgaggtgggtgaatcacttgaggccaggagtttgagaccagcctagccaacatggtgatatcctctctctactaaaaatacaaaaaaattagccgagcatggtggtgcatgtctgaaatcccagctacttgggaggctgaggcaagagaatcgcttgaacccaggagacagaggttgcagtgagccaagattgtgctgctgcactccagcctgggcgatagagactgtctcaa

SEQ ID NO: 78464 - DNA, 417 bp, Homo sapiens
tgagtgccaggaactgtgcaaggtgctggagacataagacagataagacaaataaggaatttacaggctgttagagagtaggatgtgctaaccagaggggagtgcaggttaccagaggagaggtcaggttaaccagctgggagggaaggttaccagaggagagggcaatcaaatcagagggtgtgtgttattaactcaaattcggctgattctcaaaatcatcccagttgttttataaatatatggattcctgggctctacccatggcctaatgaattggaatcttccagagccattatctatacttttaataagctccctcattgattgaaacaatcatgatagttgtggagtaaggtctcacagacacagtatagagaactttgctctgggtgcagggtggatgccaaggagggg

SEQ ID NO: 78465 - DNA, 913 bp, Homo sapiens
tgaaaggaggagatcaagaagtcggtcttttgattacaactatagaagatcgtatagtcctagaaatagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcat

SEQ ID NO: 78466 - DNA, 475 bp, Homo sapiens
ctggcagtgacccagggttacctagttccactgctcactttagaaataaggaaactgaggtgtcagataggtcaggcgactagccccaaatctcacagatgagttagtaccacctaactcactctactctagaatcctttctagctccaggttagtgccctattcttctaacttgatattgtttctgcttccttgaatgtatttttcactttgaagttgtatctatgcggaacaagcaagttatagatttagggggaatgtttttgagtaatttaaatatcagatcctggcatttaaaaaagagctgagttcagttatccaaactaattgccttcacagatctaattttgtggaagatttctcctctccattttctgttgcctacgtagtcacagttgaatgtcacatacctttcttaaacaatatcttctcttctgtccaaaccagaactttgcttattttctgttggggcaca

SEQ ID NO: 78467 - DNA, 722 bp, Homo sapiens
gatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtgaagtgagaaaaacagaatgcagctttcaaggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaaagagtaaaccaggctaccttctcctgccacagatactctatcccatttgctgtcatccaacgactaacaccgttttcacttcagaacgtcaagccttttctgttctcttcatggcctcctcccattaaagctgaaagtatctgctatcagtcatttgtcctaactgagtaagagtacattctttttagaatttaagaacctacactttagacctctcttcactaattatagaatccatcattcaacaaatatttattgattgcctactatgtgccatgctctgttccaggctttaagggtgcagtggtagcaatcacagataggaccccattattctgtctacaccttgtgaggggagatagtcaataaagaaacaaaca

SEQ ID NO: 78468 - DNA, 343 bp, Homo sapiens
tcttagactgccagagccacaggggtctgggctcagagatggctggttggagggtgggggtctgaactagggatgaagacaagggttgaaggtctctgcttgcagtaggagcatgtatatcctccccacttccccacttctgggtacaaaatgtcaggcaggccacaaaagtttatccacagggacaaaaaagtgtggatgtctctaagaaactgtaagaaagccactagtgtgggaagtgaatgcctcctgatgtagtttggatgtatgccttgcccacatctcatattgaaacataatccccaatgttagacgtggggcctggggacaggtgataggatta

SEQ ID NO: 78469 - DNA, 360 bp, Homo sapiens
cgagactctgtctctaaataaataaagaaataacagtgtaaattggctggaaagcttgctttgggttagctatagggtggcatgcctagctcatatctaaatactcatcctgctaatcctatgaacatcgtctcaccttagcaacaaaaacccatctggtagtccctgctctactcctaactggttaacaagaaaaaaaaaagtggcatttttttataggacatatacatttttcttaaatgtcctatacatttacacaatttcatttaacattgtgaactaggaacatcaggtaacttaagggagatgatcgttgtacacctcacttctcgcccaatttcacatggaatgtgaaaaaag

SEQ ID NO: 78470 - DNA, 413 bp, Homo sapiens
cttataggatataggaagttatcaggtaatttgctctggaaaggcttctagatgaagacagttactcatccactttcatcgttcctgttttcaacttttcatcattttctgagagttaaatcaataggaattatttaaaactagtattttggatgaattttgccagtgaattaatgcacatttagattgtgtttttaagactgcatataagtgctttataagtggttgcatgaatgttatttattaaaacttcatgaattcatcaccaataaagctgaggaaatctgattcccattttgtcttttcatgctaaagatgataaacatctgatgacacgccagtcattctgaaggtggctgtcaatctcgtcagcagttgattggatgacagcccagtgcagtgggaagggcgct

SEQ ID NO: 78471 - DNA, 875 bp, Homo sapiens
agaaagaaaaaaaagaaaagttagagttctatgaaaagaaaagagcatcacaaaataaaaggactcagaaacgttcttgaacttcaccctaacaaacatggcctgtgtacagacagaccaggcgactgttaaactaggaatcctgtaaaacacctcagtgccataaaaacggacaagaagaaggtcaacaagtccacacagagcttttgaaaaacaaaacagaaaaaggagataatatttcacacatattacttgaggaaaatcttccttacaccctgagaccaactatgaagaggaacaaaattctaactcagcactccaaacagaataaaatattctcaagtctgcatttcagcatatataaaataccttgaatcagaaattcaaacgtgcaaatagaaatggacaaaaagcaaggaggaataaaaagattgtcaattgaactccagaaaaaaatataagaaaaagacaaaattatctcagaaataaataaatcataaggcacccaagggataacagatgtaaattaaaatttaataaacgacattaaaaaaaatcaggaaagtggccgggcatggtggctcacacctgtaatcccagaactttgggaggccgaggttggcagatcacctaaggtcgggagtttgagaccagcctgaccaacatggagaaaccctgtctctactaaaaatacaaaaattagctggacatggtggcgcatgcctataatcccagctactcggaaggctgaggcaggagaatcactggaacccgggaggcagaggttgcggtgagccaagatcacgccattgcactccagcctgggcaacaagggcaaaattccatctcaaaaaaaaaaaaaaaaaaatcaggaa

SEQ ID NO: 78472 - DNA, 377 bp, Homo sapiens
cttttatagattatcccattatgagaggtacagagtaataacaaacccaattaaagacgtagaaagatgaaatatgaaggaaggattcaaacccaaggcagcctgactccagaaacaaaggattaaccacacaatgattacaactcacagattattacaattgcaagaagtacctaagcatgtggttataggcgggaaggaaacatgacctgctatagtaaccagaccagattggtgttctccccacttacaaagtattatttatttatttatttatttattttgtgatgaagtcttgctgtctcccaggctgggctgcagtggcaagatcttggctcactgcaacctctgcctccagggttcaagcgattctcctc

SEQ ID NO: 78473 - DNA, 1289 bp, Homo sapiens
gcagttatcatagagcacagtccctcacatcacacagctgcagagatgagtaaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtcattgtggccattgtcctgaggagtggattacatattccaacagttgttattacattggtaagaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctaatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatagagacagaaagtagaatagtggttgccaatgtctcagggaggttgaaataggagatgaccactaattgatagaacgtttctttgtgtcgtgatgaaaactttctaaatttcagtagtggtgatggttgtaactttgcgaatatactaaacatcattgatttttaatcattttaagtgcatgaaatgtatgctttgtacatgacacttcaataaagctagatgcggccgatactccgatcccttcattccccgcccaattcatca

SEQ ID NO: 78474 - DNA, 1266 bp, Homo sapiens
gcagttatcatagagcacagtccctcacatcacacagctgcagagatgagtaaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtcattgtggccattgtcctgaggagtggattacatattccaacagttgttattacattggtaagaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctaatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatagagacagaaagtagaatagtggttgccaatgtctcagggaggttgaaataggagatgaccactaattgatagaacgtttctttgtgtcgtgatgaaaactttctaaatttcagtagtggtgatggttgtaactttgcgaatatactaaacatcattgatttttaatcattttaagtgcatgaaatgtatgctttgtacatgacacttcaataaagctatccagaaaaaaaaaagcctctga

SEQ ID NO: 78475 - DNA, 250 bp, Homo sapiens
tctctgaggggctcacagaacctttagcttctctttcttcatccccttccacactcattgttgaagggagaggatggggcagggagggtccttccgggagcccagctctttttctctcactctaaatttcacctgtgtctatccttgcctgccctggagctgtaattcagacccactacttttcttgttcacttttctcacctgcatggcacacaaagacagacagaaccatccatagacacctgagcac

SEQ ID NO: 78476 - DNA, 934 bp, Homo sapiens
tgactgcctccttccagaccttctggcctcacccgcccacagtgagagctctctgtgacactctgagctccgaagaatccaacctgcccgagggtgggcaggattcagccatgagtgaaagagaactgggggaggaagcttggagctgcggcaggagctcgagggagatgtgggtggagacagaacggctgttttaaggtaccatataatactccgtagcacgggcagaactgaatcgatggtggggcactgaggcaatttccagttcttcactatcatgacattgctatgccaaacatccttgtcaatgaatctttgccatctagttccccagaaaacgatctagctttttgaagggtgtgcacattttaaagtcatttgcttgattttgccaaactggcctccagagggactactgaccgcatctcatgagcagggaagcatatgcctgtttcctcacatcctgccaacactgggcagcactgtcctttcggattgattctggtctgccaggcaaggaactctacgtcattgtcagggctggtttcgtgagccgttttacgcaggctttgtccattcctccatctgaccaggcagcctgcgggagctggcttcatctgaccttctgctttgaagcagcgcacacaggatgtttaatgaatagccgcaggcagtgaaggaagaggatccccagagcctgggacatcagctttcagtagagtgcaagcagttgcaggagccctgaacagaagtggggatggcatgctgctcttcccaaagctgcctgagctgccccaatggcgccacctcccaaggtggatgttcctccaagaacctcctcttccccttggctctgtttcaggtggtctgccttagtattcactttcatttttcatggttaggcccagctcttccttacatttgcagtgcatcc

SEQ ID NO: 78477 - DNA, 378 bp, Homo sapiens
attgatcttatatcctgtgagtttggtagaacttcaaatataatgttgaatggtaagagcaaacatccttgccttgttcccaatcttaggggaaaagtattcaatgtttcaccattaaatatgatgttagctgtagctgttcatgaatgtcctttatcaaaataaataaattctcttctattgaaactttgctaagaaacttggcattgaattttgtcaaatgttcctttctgcatctgttgaattgactatataatttttttcctttattaatgtggttaaactaaccttgaattcctaggataaatccttagtgaactcatataggtactttgaatattaattgccttctggctcctcccctaaatactggaaggc

SEQ ID NO: 78478 - DNA, 833 bp, Homo sapiens
ccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcgaatgcctctactcattcccctacacaactgtggggatggtccagctacacatagacaggaagcccagagaaacgctcgatgtgagggtccccgcaagcccgtcgggctctttcggcacctggcccccccaaagctcctcaacgaggagtagagactgccaagcccttccactcattcatcatcataaaaatgtaacttgctatggcagcctcttggccattaagggctatactttgtgacctctgtccttgagatctttgctctgacaagttctatagccttctcagtgctgctatcgtgacgcagtgtccctgctgtggctaagtaacctttcgttttgatcaagatttgtccacgcagactcctacctctgcgcctttgcccgtgccgttcccactacctggaaggtctccccgttgctctccagctttgaggtggagacagagcatctcacacttccttttggtgtctcctgacccttttgctccctgctggacttggcgatgtcctcttctgggctcccctagtccttgttttggttgtgagcgaccgcaccagggagcaaaccttctatggccccggccacaggagcagcaagcactgggcagtgccccagacggaaggaccatcgcgagaataaaggcactgagatgtctggcatcttgcccaaatggccacttatcac

SEQ ID NO: 78479 - DNA, 832 bp, Homo sapiens
tagctttctaaggcacaaggtcactttctgatacctgtaagtttctattagaatggtgatgtgagagaagtgggaaaagcatgttctttgactaggcttaaagggttaatgactaatactccagccccagggaggatcctgaatcggctttgaagttagacatgggtttgttaacaatctaacctgtatcatcagtgataaagggggggaatacggttcatttcacctgagtataaagatgtgtgaaagtgcttagcacactgtaggcattcacaactcgccttccaggacccctgtgagcaagctcatgaaaaagtgactgttggtagcacagcttgtgtcagtcctgagtatcctggctcttgtatcccatgcacaagactgctgggtgtcctcctgtattcactttactggttttagcctgaacaacaaccagagccaggccctagtttcttatttctgacttctcaccatcccatctgcactggtaaagtttgcccatctatgtagccactcctgctcatttaactaaaatgtttagctttcatcccctcagtgtatttactgtggataccaagattgcttaagcctccacacagaagtggggcaccttggacagcactggcaaagcttctacagttaccataatatcataaacccttccgccacctccacttgaggcctaaaacaaggatgtttatcttttctgccttagttcatagtttgtgagactcatattttcattaataccactaatttgtcaaaacacaccttatttgcctgctgtgtaagataatgtaacctaaaaataaaggtctttttctgaatctta

SEQ ID NO: 78480 - DNA, 415 bp, Homo sapiens
gcatagtgatggcacttaccccgtagagttgtcagcaacacttctcaaacctcagtgtgcattcaagccacctggtgaccttcttaaaatgctgattctgacttagtaggactgggtcgggcccaagattctgcatttctaacaagctcctggatgatgctgatgaagatgtaacacagatcaagggcccccaatcacagcttatccccacgccccaccatccacccatctacccgccatgctgaatgatcccgcagccaagctaaaatgcatattccagccgggctttgtggctcacgcttgtaatcccagcactttgggaggccgaggcaggcggatcacttgaggtcaggagttcgagaccaccctgtccaacacgacgaaaccctgtctctactaaaaatacaaaaaaaaa

SEQ ID NO: 78481 - DNA, 2978 bp, Homo sapiens
  misc_feature (153)..(153): n is a, c, g, or t
  misc_feature (663)..(663): n is a, c, g, or t
  misc_feature (896)..(896): n is a, c, g, or t
  misc_feature (1122)..(1122): n is a, c, g, or t
  misc_feature (1181)..(1181): n is a, c, g, or t
  misc_feature (1303)..(1303): n is a, c, g, or t
  misc_feature (1309)..(1309): n is a, c, g, or t
  misc_feature (1464)..(1464): n is a, c, g, or t
  misc_feature (1466)..(1466): n is a, c, g, or t
  misc_feature (1798)..(1798): n is a, c, g, or t
  misc_feature (1968)..(1968): n is a, c, g, or t
  misc_feature (2109)..(2109): n is a, c, g, or t
gacaccctttgctcaagtgcttttacccctcagagagagcagcctcctaatatcagacactgggtatttctttatttctctcatcagagtcttttttaaccactaggtgacaaaagtcatgattagaaaatgaaaagtttgaatattacggtntaacatttttttaaaggcaaaccattactgccaaacatctcacctttatcaatgaaaagtacctactctgtgaataaaaatatctggaacataatagtctcagttctgcctgtgtttgactgaggtttattaagctctttgacttgtatacttgtatctaaaagaaatggagcaatctcatgagtagctaaaaaaaaatctcaggcctccatttcacatttgataatctgaacatatgagacatgattttcaaatgaccacccacagaggtattaaacaatgctctgggcttttattttagataactgaagtcagactgcaaaaaagttttaacaaaacctttgagaatatcttctgtaataatccttcctctgtctctgctcctaaattcccagcatcctttagtacagtgtttccactctttctgccctcacctgggcaacgtttcatacaccagaacttatatggccctgtttacttcagcagatgttccattttttggtcactggnaggtaatcaaaatagccaatacataccaatcatcaccaaagtgtaatttttccaaaatactgtaactgtactttaatatgggtcttttagaaatgcaatgccttatatgaatgcagtgattcaaaaccaacattaattaattaccatattgattgcatttttggcctaatgcattattaatatataccagatgcaacttatccaaatgataattgatacaatgaattcatagncctaagaaaataaaatacaaaataattgagaggtaggtgtctctcacagaaagtgaccctgatcataataaaatacacacatccatattcagcgattataggaaaggaatcaatcttttgtagtattaatatacttttgtggtataatctgaaattttttccattttttataaatattaatctaaaatattctaaaaataatttatttcttggttattctcatttngagattgccttgattaacaataatccaaagaatacaattgataaatgaataagtattcntcacaggataaatagtaagggcacatctcccagtttatttatataataaataattctagcaaaagtcaactattccattttataaatgaacagaatacataaggggatataggaagacaggnctctantagattaagactgtatgtaatttggggtgaaacttatttttgtgagatttacaagtgactgtgataattctctggattgtcagccaaaacccaggaaaacatggataaagaatgactgaattttcacagcctgaaagggaagttaaggtacatgntnccatgacaaactgtaaaaactgggaaggagtgagcctggatgttatagttgagaacatttggtgaacgatagattgaaaacaatggttacaccaagggaggagagagaatttcagtacagaaggaaaatatataatatgatataatagtatgtatgaagggtcataaaataatcataaaataataaattgccaagaggaaaaggagctaatataagaaagagcaagaaaatgttataattgtttatcacatatatatgttttttgtatatgtatatatgtgtgtgtgtgtgtatatatacatatacatatacatatatatatatatatatanataaagacagggttttgctatgttacctaggctagccccaaactcctgggctcaagtgatgctcctgcatcagcctctggaagagttgggattatggatgcatggaactgcaccctataccaaaatatatttttaaaagaagcatagcatattagacctaggatgaagcntaaaaagcatctagttaatcttcttcattttgcaaatgaagagactaaggtcacgagagataatagttgttgaaagccacaaaatcaattaatgacatgataataccatgttacagtgcaatgaagtatcactaaagttcnatagataatttgtttatttgaattagagctcaacctttcccactctaattttccaaggaagtaagcaatattattcagtggggacttttctctaacctcttagcaaaaaattgctaatcattttagacttattttgtctatattaaataataataattagcatgtatccattacttactgtattaggctgttctttcattgctataaaggaatacctgagactgggtaatttataaagaaaagatatttaattggctgacagttttgcaggctgtacaagcatggccccagcatttgctcagcttctggggaggcctcagggagattttactcatgaccttatgacagaaggtgaagtgggagaaggcacaccacatggtgagagcaggagcgagggtggggaggtgccagatacttttaaacaatcagatctccaagaactcactcattattacaaggatagcaccaagccataagggatccacttgcatgacccaatcacctcctaccaggccccacctccaacatcgaggatcacatttcaacatgtgctttgagcaggataaatatccaaaccatatcacttactatatgtcagatactgtgatgagtactttatatattttcttcccctctcatttagctcttacagcaacatcgaggatcacatttcaacatgtgatttgaacaggataaatatccaaaccatatcacttactatatgtcagatactgtgacaagtactttatatattttctttccctctcatttagctcttatagcaaccttatgaggaaggcattattagtgttccaattttcggatgaagaaatggagagtaaatgggggagtaacttaaccaaactctc

SEQ ID NO: 78482 - DNA, 335 bp, Homo sapiens
gttagaatttacgcccgatgaaatatgaatagtgaaaatggaattttggcgtaggtttggtctagggtgtagcctgagaaataggggaaatcagtgaatgaagcctcctatgaatggcaaataacagctcctattgataggacatcgtactacacgacacgtactccggaattccgctgcaaattcaagatagcacaccctccttgggtttgataatctgctagaacctcttacagcattcaggaaaatgccatacttaacaattaccattttaccaaaaaggacatgagtgaacagccagatgcacaggtacatgtggcaagatccggaagggt

SEQ ID NO: 78483 - DNA, 368 bp, Homo sapiens
tatttactattgcaaaagaaaatatgcgtacaaaggtattttgttgtccgatatagatttcttacaaatgaaaataaatgttggccaattatggtccttagaatgattcaaggattataaatcaagactgaaccaaaaacttcttaaaattattttctaaataagcatgatctaggtaaatggctttcaaatgaaagcagaccacaagcatcacctggagaatttattgaaatgcgtattcctgggacctcaccccacaaggattctatttcagtagttctgcaactaggatctggagtctgtttttaacatatgccccaggtggtttgaccacattttgctaaaactgaatctaggtgctaagaggt

SEQ ID NO: 78484 - DNA, 1462 bp, Homo sapiens
gatttgattgatcaggaagatacatcaattctaagccaattatacctaataacgtagcattaaaatatatgaagcgatatttgagagaagagacttctggttctaaacaaatggagcatacatattttttcttattcttcccactaagtacagctaaaaactctggaaataattcttaaacattagagaagagaaaaagactagctagggactttggtacttgaagaatgttatggtgtgaaaggagtggaaataaaatattaatctgaaaaatatacaacatgttacattgtgtatatagtcttaaaatggtttatagactatcataaactgatacatacaaatatgattgtgggatatagacattaataatcctttttctatggtgcatagagttaatttttaagaaaaaaacgacttttcataatactccagcctcaaattttgcctcaccagaatcagtgtgttttcaagaactggaactttctcaggttgttttcattttttaaaatgatcgactttactatttgattacatttattatggaaaatgtaaatatgcagaagaatgctaaaatagaaagtacccattatcccatcatcccccaaacaacaaaagataatgtgtattcatttctagtccttttatgtggatatatagaattttaaaaacaaaatactgtaaaattatatcctgatttttcacattttggagtaaccatttcttgaggacaatattctttgaaaacatgatcttcagtttcattgtttacatcagagtctaattatagctgtaccatactttacctccaaatatttggtatttcagattgttttaaatttttgctattgtaaatttgtatgaatatatttttatacataactgtattgctgataatttgtttaagataaattatgggaacagagttaccaattcaaagagtatagctatttttaaatttttgatacattttactaaattacagaaagattgtacttatttatagtcataccaatgaatgtcccggaaatgtccatttttttcatatcccttgcccaaagagaatggtggaggttacctctcaaacttttattattacaaattttaatagaggtaaaatattacctccttatcttaattttgcactttttctctgataattaatgaagtatgatctttttccatatgtttacagctgatttgctttgcttttctgtatattttaagcagcgtaggtcttgtaggagcttccaatgtaagccattacttgtcatatcattagttcttcctaaatgagcaagacatgaaactacatgtatttatcacattatttcaagttaagtatcccaatgtgactgaaattataatcttttctcctgggcagccatgttattttaatgtcttgtaatctaacaaaattggctcttattcttcacgtaataaagaggttttgaatattcca

SEQ ID NO: 78485 - DNA, 452 bp, Homo sapiens
ctgttctaaaaattaaagcttataaaacaaatgcaaacatgcctttggacccaggaggaaactcctgggaatttttctttggaaataactaaggatgattcatccacaatgatgtgtgtcacagagatgtgggtaatagtgaaaaggtagaaataatttaaatgcccaatattaggtatgataaatccatacaaatcaatcatgatcataatcttacagaaatatatttcttgatatgacattcatgattgataactgagtggaaaaagcagactgtgaaggagactgtcaagtatgagctgattttataaaagataacttatttttatatatgtatagaaggtgtatggggaaatatatttcactgtgataatggtgattatctgtggtggtaacataatggaattttttttcttttttatggaaccaatacttgtgtgttacagaaagta

SEQ ID NO: 78486 - DNA, 888 bp, Homo sapiens
cgtcactatcagaaaacatgaaaattcagtggaatgctggaatcctgatacaaatacttggacttctctagagagaatgaatgaaagccgaagtactcttggagtagtagtacttgcaggagaactttatgccttaggtggttatgatggacaatcttatttacaatctgtagagaagtacattcccaaaataagaaaatggcaacctgtggcaccaatgacgacaacaagaagttgttttgctgcagcggtattggatggaatgatatatgccattggtgggtatggtcctgcccacatgaacaggtatttaacttaataattaaattgcatatgtttatggatttttaaaagtctcattagcaatgatttctgagttttaaacaatttgtgtgtatgaatgaacttccggcatttgggaaacttaatctgctccatggatataattgtaattgttttacatgggaatttaatacaaacctaacaatcaaatccctctcattaaattttacattcattcactataaatggactagattttaaaactcagaaacctaaaaataagatgaagttagacaactttagattttgtgtggtgtgtacatctatgtgcacagtatgtaaattatcttttattgtattgcttaatagaataaagaagtagaaatttaattcctgtgtgtctatacaatattatagcacatcataaacttaaaaccttatttaaatattcctttctgaattctttcctgtaatcatacatgtatcatcaggtatttgacttgtgctggagtttgaatttgtgatatctgtattctgtagttttatctgaataaaggagaaatatatatgagaaaataaaagtatgaagtaactagttatatgaga

SEQ ID NO: 78487 - DNA, 840 bp, Homo sapiens
tttgccgcttgcacaatataatggaatagcatatgggattgcaccttgtttacaaggtaagcttttatctttgcaatcttatcagcaaaacctaagcatttgtggcagactactcttgtttaatatctctctattatgtgaacttttaaagctgtagtgggttttagttttgctttgacaggaagaatgacacaaaagatctgtaaactaaattttttttaaatatttgcagtgtggagcgttatgatccaagtaaggactcctgggagatggttgcatccatggcagataaaaggattcactttggcgtgggtgtcatgctaggctttatttttgtggtgggtggacataatggagtctcacatttgtccagcattgaaagatacgatcctcatcaaaatcagtggactgtgtgtagaccaatgaaagaacctagaacaggagttggtgctgctgtaatcgataactacctttatgtcgtcggtggtcactcagggtcttcctatctgaatacagtgcagaaatatgatcctatctcagatacgtggctggattcagctggcatgatatactgtcgctgcaactttgggttaactgcactttgacaaatgtgaactctcggaaatagtatggtggtgaaacttgtactgcatgaacatccggatggcccagttttctgaaacccacaagctgcattgctttctttttaacttgaagtagcatgaaggctcaaaagttttgttgggtacttttaattgagaagtagttttggttgctcttgattacacagtaaatcaataatcaaaaagaaaaaaaagaaaaaaaaaaagtaaagacttt

SEQ ID NO: 78488 - DNA, 340 bp, Homo sapiens
taaattttttttaaatatttgcagtgtggagcgttatgatccaagtaaggactcctgggagatggttgcatccatggcagataaaaggattcactttggcgtgggtgtcatgctaggctttatttttgtggtgggtggacataatggagtctcacatttgtccagcattgaaagatacgatcctcatcaaaatcagtggactgtgtgtagaccaatgaaagaacctagaacaggtaataagaatttattaatttctaaacatgtaaggcaatgttttctataatgatgtgcttgcaataatagttccttggaatatagcagtaggaatattacttgtcca

SEQ ID NO: 78489 - DNA, 914 bp, Homo sapiens
cgtcactatcagaaaacatgaaaattcagtggaatgctggaatcctgatacaaatacttggacttctctagagagaatgaatgaaagccgaagtactcttggagtagtagtacttgcaggagaactttatgccttaggtggttatgatggacaatcttatttacaatctgtagagaagtacattcccaaaataagaaaatggcaacctgtggcaccaatgacgacaacaagaagttgttttgctgcagcggtattggatggaatgatatatgccattggtgggtatggtcctgcccacatgaacagtgtggagcgttatgatccaagtaaggactcctgggagatggttgcatccatggcagataaaaggattcactttggcgtgggtgtcatgctaggctttatttttgtggtgggtggacataatggagtctcacatttgtccagcattgaaagatacgatcctcatcaaaatcagtggactgtgtgtagaccaatgaaagaacctagaacaggagttggtgctgctgtaatcgataactacctttatgtcgtcggtggtcactcagggtcttcctatctgaatacagtgcagaaatatgatcctatctcagatacgtggctggattcagctggcatgatatactgtcgctgcaactttgggttaactgcactttgacaaatgtgaactctcggaaatagtatggtggtgaaacttgtactgcatgaacatccggatggcccagttttctgaaacccacaagctgcattgctttctttttaacttgaagtagcatgaaggctcaaaagttttgttgggtacttttaattgagaagtagttttggttgctcttgattacacagtaaatcaataatcaaaaagaaaaaaaagaaaaaaaaaaagtaaagacttt

SEQ ID NO: 78490 - DNA, 544 bp, Homo sapiens
gcaggcgctcctttcctccctctgtgcctgttctcagactctgattcaaagcaggagccccgagcacccttcactgccccgtgggctcttttccttaagtattttcaagtttaattcaagtccttgttggcttcatttttcatattaataaggcatttattaacaaacccattcatgatgtgcaaatctgaaggctttaaactacggtgaactgttattttacagagagggtgtttttggtgctaattggagcattgttacagtcatttattcttttaagtttatttttaagcgtattattttttatcagtggtattaagtgcatttatagggttatgcagccagcaccactattttcaaatattttggttacctgaaaatgaaactctgtaaatacaaagagtcactcccccagcctcctacacccctcgttccactttctgtctgtgaattcgatgactgtaactgcctcctccaagtggactcacagtacttggccttttgtgactggctgatgtcaccgatcgtgatgtcctcaaggttc

SEQ ID NO: 78491 - DNA, 707 bp, Homo sapiens
ccattgtactcaagcctgggcgacactgagactacgtctcaaaaaaataatcaatcaataaataaaagaggcgtccacgttaacgagtccacagtcctaacaagtgctgcaggctggacgcggggcagcgtcccacccagtgtctggtgcagggcatttaggggcttggcctccaggagaggcgagcccggggctgggtgcgagcactgctgctggccaggccactcacgttatgcggccgttcctgatacttcaacacggcccttgtgggcgaatgtgtggaatctcggaacaagcggagtggggaacagggctctgcggtgaagcccaggctgaggcagcccctcatctgctcacggtgccaggagctccctgcctcctggtcctgaggagccgcgggattcctcagggacactagggcctctgcagcgcgcctgcgccaggcagccacgcgctgcgcacgaattctgtctcagcctggagaaaaacacctccgtgcgccctcgcccagcaccagctttccgcggggcgtgcaaggggctcctcctagccccacagccctgtctttccacggggacaccaaggccctggaacggccccgcggccagcgtctcgcccgtgtttaacgagaacttaatccccgtgcccgttacctccccgaagtcccgggactaggtgactaggccccgaagcaagagtcgcagtcg

SEQ ID NO: 78492 - DNA, 486 bp, Homo sapiens
aaagggagatttgttaacagccaatattcaaagagatgagagatgggtgtaccagcctgtatccactttagtcctctcttgggactactgggatctacttgctttcttcattgttagttatattaagttatatatgatttctccaagattctgcatggtcacaatttttgggaaaaactttgagaagaggtttggtggtcaccctgccatagctggtccctaaaccataaatgatactcatcatctctctcatccatcaccctttctaaatttctgtcttccttggttaacacttctgcttgtcaagatggcttgcctggtagaatggctcagaccctcattcctgttataaataggcccctggtccatggtggctcatgcctgtaatcccagcactttggaaggccaaggtggatgaatcatgaggtcaggagttcaagaccagtttggccaacatggtgaaaccccgactctactaaaaataca

SEQ ID NO: 78493 - DNA, 182 bp, Homo sapiens
ggcaggtgctggaagaaggcccctggaggaaccttgaactgcagatagtttaaggcacttggaaattacactgactttcagacagagcatatcacattagtttatctaaagccccaaatgaagaggatggggtgggggtggggagcctactatttactgtggaaccactgagaaaatatcct

SEQ ID NO: 78494 - DNA, 406 bp, Homo sapiens
gactgaaatcaagcatcttttctgatctcagtggtacaaaactgaaagtcaataacaggaagaaaactagaaaacctccacaaatatgtgtaaacctaaacaaccctgctccctcaacaaccccggcagtaggtcaaagaagaaaccctaaagggaaatcaaaaaatataatgagacaaattaaaatggaaacacaacatattaaaaccaaacttatggggtacagtagaagcagctctaaaagggaagcctatggcaataagtgcctacattgagaaaaaagacatatctgaaataaacaacctaactttatacttgaaggaatgagaaaaagaacaaactaagcccaaacttagtagaaggaaggaaataacaaagctcagagccgaaataaatgaagagacta

SEQ ID NO: 78495 - DNA, 332 bp, Homo sapiens
acggcccaacactcctaaggactctttataactgacttatggtctaggtgtgccacatcaagaggggctgccgatttccagaaatcactagcttaaaaaatatatcaaataagcaagccactctaccactctgggaccctgtgcatttgaagcttggtttgttccaaatcaaagtaagaacagaaaatagaaaatcggcaaaatttagctattgcagcacagagagaaaaggaacttttagacacataagcaatgggcaggttttaatcacaggcctagatctatggcttttatatgcacacattataattaataagtaaatatacatctac

SEQ ID NO: 78496 - DNA, 473 bp, Homo sapiens
aacacagatggagggcaagagggacagatggctctagctgggctgcctgggtgagatgctggggcctggccaggacagtgtcagttcccagaggtcctgggacaggggagaagggaggtcagggtcacagagagagaggcaggaagtagcaaaggcagagtctgcctgtgcaccaagcccgacccccctgctctgcccctgggccgtctctacctcaccccctcagctcccccggtctgagagaggggaggccgagcaggctgcagacccagccacatggggcaggggaaggagaggctggcattggtggagccacccactgcactgccagtcatacaaagaagtctatcacacagaattatgtgcagtattttttttttttgagacagagttttgatcttgtctctcaggctgggttgcaatggcacaatctcggctcactgcaacctccacctcctggcttcaagcgattc

SEQ ID NO: 78497 - DNA, 643 bp, Homo sapiens
aacacagatggagggcaagagggacagatggctctagctgggctgcctgggtgagatgctggggcctggccaggacagtgtcagttcccagaggtcctgggacaggggagaagggaggtcagggtcacagagagagaggcaggaagtagcaaaggcagagtctgcctgtgcaccaagcccgacccccctgctctgcccctgggccgtctctacctcaccccctcagctcccccggtctgagagaggggaggccgagcaggctgcagacccagccacatggggcaggggaaggagaggctggcattgtggtgcgctttcggcttactgcaaactctgcctcccgggttcaagtgattcttgtgcctcagcctcctaagtagctgggattacaggcatgtgccacacacctggctaatttttgtatttttagtagagatggggtttcaacatgttggccaggttggtctcgaactcctgacctcaagtgatccacctgcctgacctcaagtgatccacctgcctcggcctcccaaagtgctgggattacaggcgtgagccaccacgcccagccaccttttctatgtttagatacataaacactcaccactgtgtcacagtcacctacagtattcagtacagtagc

SEQ ID NO: 78498 - DNA, 550 bp, Homo sapiens
tggagctatttgtcagaaaaaactagatggaaagtagaggtggatgactttctgccctgtgaatgatagatcttcattcagggagtattttggagccagtgacctgtgacagttgtgagacttctcataatcattctgtggatggttggggtcttagaagaagtaatgattttgttttgaactggttgcatcagtttgaaccagagtttgtactaagggtattccaactgctttatttcctactctgtttagtctggggattgaaaaaggattacattttgggtgggttggtgcctattgacctatcctgtgtagcttagattttaatttgaatcatctggttctctttctttctctcaggcaatgtcactatctctgtttgtttaattatggggtgactcaagaaagcaaaggaagaggagcagcagacggggtttcctggggaaggaatggcaggtcatggctggtttttataagtgagttcctaagtgagaagtggtacaagaatatagagagaattaggaaatttaattttagaagagaccaaagg

SEQ ID NO: 78499 - DNA, 895 bp, Homo sapiens
caggaagcaagagagagagacagaggggaggtaacaggctccttttagccatcagctctcatgggaattgacagaacgagaattcactcacccccacccacctcctggaggggattaatctattcatgagggatccacccccatgacccaaacacctcccattaggcctcacctccaacactggagatcagactccaacattagatttggaagggacaagcatccaagctgtagcatggttccaggttggaaatcattttcccttcaacattcgaaggcagtgcactcagtgttgctgttgagaaatctgaagccgtgcagattcccatctccgggttgtatctgtttgctcgggatgccataacaaaggaccacagactggggggtttaaacagcagaagtttactttctcacagtactggaggctggaagtctgaggtcaaggtgctggcggtgtcggtttctcctgagccctctctcttttgccggggctgttctgcttgctggattggaaatgattttagcccctcatgccaggaagaaaacataggcagatttctcaccagctaaaaaggaaggaaaaattgtgaagtgaaattttctactggctgtggtttatccatgttaaattgtaaagcatataacacagatggaatccggcacatgcaaaacactcacaaaacctagttactactactgctggcgctgcggctacacgactacaactactactacagccactactctcctcctactgctactgctgctgctgctagtgtttcgtaaagtggagctacagaaatcaacattttttttcttagctgcacagtgaattcgttttttggactccagtattcttcctgaaggtctgtttcatcctagtatgactctcact

SEQ ID NO: 78500 - DNA, 369 bp, Homo sapiens
ttggaaagatgaaaaaattctggaagcagaaggtggtgatggttgcataacaatgtgaatgtacttaatgccatgaactatatacattttaaaatggttaaaatggtaaattttatattatatatattttatcacagtttaaaaataaaaaatgccactcactcaaggagaggagctgacgttgaaagcaattctgttttgcccttggtaccaaaattgaagaaggctgggggaagaagcatggtgggcaagcatgagaggcagatagtgtgggctcctgggcaagggcctgcaccctgctcttggggaatgggcagaaaccttgacagatttaagacaaaggaaacttggacctcatttcctaggtaa

SEQ ID NO: 78501 - DNA, 339 bp, Homo sapiens
tatgatctacttttcaatatgcatttgatacactttctgggaatgctttaggcaaagcgtggagttgcttatatatcattagcatgaaacttagtaagtattaataactgagaactcgttttgcccctacaaagctcacatatttatttagaccctttatccaccaagtgaaggtcacaaataaagctatctcttctcaaatcaaggcttaaattagagcatttaatcagcctgtattatgcagcatagatgtcaaagatacttgaagggatttccactatccagcttgaagggatgctatctaaccaaacctggataaattgagcattaaaattaaaa

SEQ ID NO: 78502 - DNA, 459 bp, Homo sapiens
aattaagtatcatatacccttttgtctcccaactgccggtcagttatgctttggacattattttagtagccatagtaagttgcttctaaaagtgaaaaacacaaatgttatgtttcttaatttcgttgaattagtcactataatgttgatgtagctaatcataaaaaggaatttgtgtcttatttgtctaatagaattcaaaatgaatttataatgtatataatttgatagggctacaataacaaaataccacacactgggtggatcaaacaaaaggaatttgttttcttactgttccagaggctagaagtctaggatcaaggtgtcaacaggttgtgtttcttctgaggcctcactgcctggcttggtctgtgtgttgtctatgtcacctcttggtctatgtgttgtctatgtcatatcggattaaagcctgcacatatgaactcattttactttaat

SEQ ID NO: 78503 - DNA, 2760 bp, Homo sapiens
  misc_feature (654)..(654): n is a, c, g, or t
  misc_feature (2754)..(2754): n is a, c, g, or t
  misc_feature (2756)..(2756): n is a, c, g, or t
  misc_feature (2760)..(2760): n is a, c, g, or t
aggagtctgtcagctacggaggacaatgaccttgcagacaccaccgcctgagtgagaaccaggggtctgtgcctctcctcattccccgctcttgcccttgtcaagcctgcaccagcatgtcaggaacctccaaggagagtctggggcatggggggctgccagggttgggcaagacctgcttaacaaccatggacacaaagctgaacatgctgaacgagaaggtggaccagctcctgcacttccaagaagatgtcacagagaagttgcagagcatgtgccgagacatgggccacctggagcggggcctgcacaggctggaggcctcccgggcaccgggcccgggcggggctgatggggttccccacattgacacccaggctgggtggcccgaggtcctggagctggtgagggccatgcagcaggatgcggcccagcacggtgccaggctggaggccctcttcaggatggtggctgcggtggacagggccatcgctttggtgggggccacgttccagaaatcaaaggtggcggatttcctcatgcaggggcgtgtgccctggaggagaggcagcccaggtgacagccctgaggagaataaagagcgagtggaagaagagggaggaaaaccaaagcatgtgctgagcaccagtgggntgcagtctgatgccagggagcctggggaagagagccagaaggcggacgtgctggaggggacagcggagaggctgccccccatcagagcgtcagggctgggagctgaccccgcccaggcagtggtctcaccgggccagggagatggtgttcctggcccagcccaggcattccctggccacctgcccctgcccacaaaggtggaagccaaggctcctgagacacccagcgagaacctcaggactggcctggaattggctccagcacccggcagggtcaatgtggtctccccgagcctggaggttgcaccaggtgcaggacaaggagcatcgtccagcaggcctgaccctgagcccttagaggaaggcacgaggctgactccagggcctggccctcagtgcccagggcctccagggctgccagcccaggccagggcaacccacagtggtggagaaacacctccaaggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattactgaggccagtggtgaagtgaagagatgactcaaacatttaaataatttggcttttggtattattgattccacttatttgtaaatggttatggctgctgcttcctgtggatgaaagtggctgtaagagctcctagacgtttntnctgn

SEQ ID NO: 78504 - DNA, 1100 bp, Homo sapiens
  misc_feature (1094)..(1094): n is a, c, g, or t
  misc_feature (1096)..(1096): n is a, c, g, or t
  misc_feature (1100)..(1100): n is a, c, g, or t
tgccgtgtggctatgtctctgcaggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattactgaggccagtggtgaagtgaagagatgactcaaacatttaaataatttggcttttggtattattgattccacttatttgtaaatggttatggctgctgcttcctgtggatgaaagtggctgtaagagctcctagacgtttntnctgn

SEQ ID NO: 78505 - DNA, 924 bp, Homo sapiens
aatttttgtattttttagtagagacagggtttcaccatgctggccagggtggcctcgaactcctgacctcaggtgatctcccaaagtgctgggtctcccaaagtgctgggattacaggcgtgagcaattgcgcctggcctctctgggtagtattttgatagttagagggtgcatttatttctgtcctttgccagaagacatagactgtacacatttttttaaggtacttatataactatactgtacattaaaatataccactagggaagtggagtaccatgttctttggccactgtatccagtttggagagttaagtttttactttagggaagaagtggcagggtggggaggaaacagacccctcagcccttaccatttttcacgtagctggttctttctcatccttcctgtcccatcctacccaaacattttcctgcaccaacttctattgtagcaccttgaatatttccttcataacattgttttctcagaagtagaatagtatttggtacaagttggtactcaataaacatttattaaatgaatgaatatggaggaaatgatgtactcagctggctttcatgtattaaactctattttcaaaggacgaaaagggtcccatttccaagatacatgctgatttcataaagaatttggtcagatcttggctcataagtcatattacaaatatctttaacaggtcagctctggcttacaagccacacaaaggatctgaacctcttggtagataacagttatatttacaaaatgtatataaaataaaatgttacataaattaaaaataaaattatatataaatatatatttttaacatttatatattaattttgcaaatataaatatgaaaagtggctaacattgtatataaaatgcaatttggaataaaatacatttatgtaatg

SEQ ID NO: 78506 - DNA, 361 bp, Homo sapiens
agaatttataatggtaggaatttgacatttctgcctttcattctgaaaagatacattgattaaagtgatgtcaaactcagttaatggaggcggtgcagttatttgaaatatacagggtatataatttgaaggcacgccaaatcacaatgacaaggaataatgatgaccttggtttatttttatacagtacattcaggttttgattggattcagagagaggcaatggttttctttctcacaaagtcctgctatagtcctaggaggtttgtgttctgttatcaaggcagttggttcgtattggaatattttctggggaaggtcatgggctgcagtgtgggaaataaacgtttttattaaatgc

SEQ ID NO: 78507 - DNA, 1082 bp, Homo sapiens
cactttcctttcctgccctctcctatcttctccagatctgcctgtgaaaggacccaattctaggaccccccaggatggttaggcccttcctctgaaagtacactttgcaatttgttagtctcctcaagaaccccagcgatcgaaactgatgcacacaaattgcatgtgttcaaaggagcaattttgaatctagctttgttgatcctgggagaaatctttgacctgtgttagtgaaaggctatggtgtttctcagctgattataatagcgaggtagctgaatgcaaaaaaacagtttcagagaatggtagagtatatcctccaaaggtgatactcgcttctctattctggtgagagaaacaagagctaaagcaaaattctacagagggctttatttggagagaggtggattttatttataatgcatttaaaattcaaaatctttctagtttgaactcttgacattctgattaatgcatttttattcaactgttaattattcctcgatacacctcgccatcacttgtgtatcccttttctacatgtgacctttccctggccacatctgctactctctttgagcatgatgcctctactgtattctattccagagctcattgttttgtcagttttttttctctccacaaaaaaagatgatcaaataattacatagaatttttcccttctcagtctttgggtaactaagtgtggttttattgacgatgaaatacaagatgggtcatttaaaagcaacttcttgtcatcacttggtattttgctaaatccacggtgagctggagctcccgtagtcacctatcaccgcgtgtattttaaggagtcagatattctcgaaactgttaagatcatgaaagacaaagagactaaggaactgtcacagattaaaggagactaaagatacttgacaactgaatgtaatatatgacactcaaccggctcctgtaccagaaaaaggacattggttatattggtgaggtttgaatatctgtagattaccaatactattcttggttatggtggttatgtaagatttagagaagttgaataaaggatataaggacaaaaa

SEQ ID NO: 78508 - DNA, 834 bp, Homo sapiens
tgtagactcatgttaatagcagccttattcgaaatagccaagatgtgaaagcaactcaagtgtccacagatgaaaggataagcaaattgtggtatatacacatgatggattattattcaatcttaaaatggaaagaaattttgccatatgctgcagtatggataaaacttagagacatcacgctaaatgaaataagccagacacacaacaaacaaatactgtatgttccactctatgagtagtcaaaatcatgaagacatagtagcatggtggttgccagggagtggaggaggaggcaatgaaaggttagtgtttcatgtgtaaaaggtttcagttctgcaagatgaaaatagttctggagatggatgatggtgatggctgcacaacattatgaatgtacttaatgctactgaactgaacacttaaaaatggttaagatagtaaatttgatgttatgtgcattttcccacagtcaaaaaaaaaattgaggaaaaatattaatatttttaaaaatctgagattaaagaaactaataaaatgtaggtctgcacatttttctggacctgtagtagttgcaggcagatccctgaggtcaggagttcgagaccagcctggtcaacgtggtgaaacccccgtctctactaaaactgcaaaaattagctgggtgtggtggcaggtgcctgtaatcccagctactcgggaggctgaggtaggagaattgcttgaacccagcagacagaggttgcagtgagctgagatcgcgccactgcactcccacctcggcgacagagcgagactccatctcaaaaaaaaaaaaaaaatctgcagtagttt

SEQ ID NO: 78509 - DNA, 224 bp, Homo sapiens
cggaggatcaccacattccctttctgtgtgtatacactctggaaggcgctcggaggatcaccacattccctttctatgtgtatacactctggaaggcgctcggaggatcaccacattccctttctatgtgtgtacactctggaaggcgttcagaggttcaccacattccctttctatgtatatacactctggaaggcggttggaggttcaccacattccctttc

SEQ ID NO: 78510 - DNA, 548 bp, Homo sapiens
gggatgaagattgcctggtactttgggaaatataagagagggtgttctcagaggctaaccagggaaaggaaaatctaaatgaaaataagaactgtttcaaaaatcccattattattacccagttgacttaaatagaaaagtttcctcttttgtggatggggaagagtgcttttgtttttaggataattgagacgttcccagtatcaaaattgcaaatatttccagtatcttggtaatgatttccatgaggactataaagaaaaaagtttggagacctcccctccccctagcctccacccccaaccccgttcattttgctaagcaaaaaataaccagaggccctgtactaaattttgactttgaggatcaacatcgaaccttgtaaaatataaagcaaatacatttcttatatttttctaatcttgttaatggcagtcttcagattttatgttcttgatattcatttagaaacgtcttcctttaagtcatggcaatttgaagcattgaatagctttatcttaattgataatggtcagttttaaaacttg

SEQ ID NO: 78511 - DNA, 298 bp, Homo sapiens
ctcaggcctcacctagctccaggcccgcactccacagaaaaaaagattgacccggcgtgggggtgggggcttccagagatggcaaccctctggcaggaatccctcaggatcctgtcagagcctggtctctgggagttgacggagggagggagggagggagagagagagagagaaagagagagagattatcccagaatgtgcaggggaggaagcataagcaagggctcaggctcagagagacctgagcccaggcacatgcttgctgtgtgacctcggataaaacacttaacttctctga

SEQ ID NO: 78512 - DNA, 476 bp, Homo sapiens
caggtatcctcattctagattataacctttattcttatcaaatgcctccagtcccacaattcgctaagaattctctttctggacttgatagtgatttaatgattccccccgcccatggaatggtaggctcctaattaagtggatttaaaggcaaaaagggatgtgtgagaaggcacaagaagtggcttcatcttgcaaggtgactgtcagacaagtgggttccaacctgttaaaataagggaggaatggccacatcccgtagggactgctgtagctgaccaggaagacacaatgagggcagcagacagggctctccctgtccgctgagtcctcccatgaactcatgtttccaaaggccccactctttcttggtcagtgtcccagtttttatagaagagacctgatgaggctgtggagtaattgtataaaagcttgcactgttttcctgacttgacctgacaatgtggcgttatctt

SEQ ID NO: 78513 - DNA, 520 bp, Homo sapiens
attcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggattagttataaaaggctttagtagctcaaaaatactcttgatttcacatttctaaattatttgtgattttaatttaaaaaaa

SEQ ID NO: 78514 - DNA, 968 bp, Homo sapiens
attcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggattagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacatttttta

SEQ ID NO: 78515 - DNA, 1407 bp, Homo sapiens
attcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggattagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacactttatgtttttcccttttttatgttggttgatataacacaaagagatatt

SEQ ID NO: 78516 - DNA, 1417 bp, Homo sapiens
gggggatctcatttctccccaggggctctaggctgtggatgtgagaaggggagcaagggaggcagatggcgacaaggaacagccccatgcccctgggcacggctcagggtgatcctggagaggcaggaacacggcccggccctgacgccagcctccgggacacaggtgcggccactcagctcaagatgaagcccaggaaggtgcacaagatcaaggcggtcatcatcgacctgggctcccagtactgcaagtgcggctacgcgggagagccgaggcccacctacttcatctcctccaccgtgggcaaacgctgccccgaggcggccgacgctggcgacacccgcaagtggactttagtgggccatgagctgctcaacacggaggcgcctctcaagctggtgaacccgctgaagcacggcatcgtggtggactgggactgcgtgcaggacatctgggagtacatcttccgcaccgccatgaagatcctccccgaggagcacgctgtgctggtctccgaccctccgctcagccccagcagcaaccgggagaagtacgcggagctcatgtttgagaccttcggcatcccagccatgcacgtgacgtcccagtcgttgctgtccatctattcctacggcaagacctcggggctggtggtggagagcgggcacggcgtctcgcacgtggtgcccatatccgagggcgacgtgctgccgggcctgaccagccgcgccgactacgctgggggtgacctcaccaactacctgatgcagctgctcaatgaggcgggccacgcattcacggacgaccacctgcacatcatagagcacatcaagaagaagtgctgctatgcggccttcctgcccgaggaggagctgggcctggtcccggaggagctgcgcgtggactacgagctcccggacggcaaactcatcactattggccaggagcgcttccgttgctctgagatgctcttccagccctccctggcaggcagcacccagccgggcctcccggagctcacagctgcctgcctgggccgctgccaggacacgggcttcaaggaggagatggccgccaacgtgctactgtgtggcggctgcactatgctggatggcttccccgagcgcttccagagggagctgagcctcctctgccccggggacagccctgcagtggctgccgctcctgagaggaagacctccgtgtggaccggcggttccatcctggcctccctgcaggccttccaacagctctgggtcagcaaggaagagtttgaggagcggggcagcgtggccatctacagcaagtgctgagcctcggcatttccacagacaaggcctccagcacagatggccacaggcctctctatacacatttacagaatttcacataaaggtttactctgaaaaaaaaaatg

SEQ ID NO: 78517 - DNA, 575 bp, Homo sapiens
ttctaaattgtattcctaaatgatgttaactattgttccccgaaattgcatcagggttaaaaatttgtgttgaggttggtttgaattaatctaaatattcaacatgtgctcttgccataaagcagaaagcaaaggcctgaagtagacaagctttttaacctttctggcatttcatagatttcaccttaataaaattctgaaaactcccattatagtataattagcttcctttattttatttatgtatttttttgagacacctgtgtaggtatctgtggacacatttatgagaatcggttggccctgcaactctcccagtcaagctcactgccaggctaactttggcttgtgtaccttctcctcttagtttcaccaatacttgacagagtctggctcagcacagctctatgggatggagggccagatggctcccaaagagccctgaccagaggcacaggcctgtgaccaggtgtcctattctaggacagatggcttgaattgcctcctgctcccttttgctctgacagtctctgggactactgagcgctggggccactacagaaattggatgatgc

SEQ ID NO: 78518 - DNA, 335 bp, Homo sapiens
aagtcagggaagctagattatgtttagtgtcataagtacaaataaagcagcattagcatttaagagtgacagagaaagcaagctgaatttatagtctgtgttttctgctactgttactattctctgagttgacatatttgagttctaagactgcaaagatatattcctgatgacgtcagtctctcatcctagggtttcaaactcctttaaaaataaggtagctatgataccttataaacttattggctaaagggatcagaattgccctacctctctgctttcctcctattcccaaccttagtgactacataacagaggcagttttccagatattc

SEQ ID NO: 78519 - DNA, 763 bp, Homo sapiens
ggtgacttggccatagtcacacagccacctggatagagatgagtggtgagtggtgaacccggagaaacatggcttcttgcctccttggtctttgtgcacgggcctcccgcttcccgagtctctcctggcccagcagtggtttgctgaaggctgttttattttaggcaccggctgagctacctctgatcttgttgggttagcctaggtgtggttctttggtttttcagtttgtataaccatgttctttgttcagctcctatcagggttagggaggtcaaacacctatgtgtcaggatacgcctgacacacactatttaaaactcacactgttttaaatgtatagtatttaaaactttatggtcagctgtacttaccggctgagtacagaactaggaaagctggtggctacttgcaaggagcagctgcttagtagcggaggttgagtaataaggaccccagttgctgaacagctcctggaagaatatctgttcccggctgggcgtgatggctcaagcctgtaatcccagcactttgggaggccaaggcgggtggattgcctgagctcaggagttcgagactaccctgggtaacatggtgaaaccctgtctctactaaaaatacaaaaattagccaggcatggtggcgggtgcctgtagtcccggtgactcgagaggctgaggcaggagaatcgcttgaacctgagaggcggaggttacaatgagctgagatcatgccgctgcattccagcctgagtgacagagcg

SEQ ID NO: 78520 - DNA, 2603 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgc

SEQ ID NO: 78521 - DNA, 2507 bp, Homo sapiens
tcgcaggtgaggcccggtttatcggacgagggccgggccgcgccgccgctgccgccgccgcgcgcggattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgc

SEQ ID NO: 78522 - DNA, 695 bp, Homo sapiens
cggatccccattttcccccagggaaacaggttatcacatatttccgaatttaattcggctcccctttagggaatttggcccctgagggccaagatttcggcccaggccatgactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgc

SEQ ID NO: 78523 - DNA, 807 bp, Homo sapiens
  misc_feature (48)..(48): n is a, c, g, or t
  misc_feature (54)..(54): n is a, c, g, or t
  misc_feature (57)..(57): n is a, c, g, or t
aacaataatgtcatagtagatcctggtgttaatcatcacgagggcggnccggcngtngtgccgcgccgcgcgcggattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgggaccttccttgtggggggctctcgctctcgcggggcgtttggtctccggaggccgtccactgggggggggccttg

SEQ ID NO: 78524 - DNA, 744 bp, Homo sapiens
tcgttgtaaatctagatgggccgccggctcgatcgacgtcgcacgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcggcaaaaagttgtgaacacacaggtgggtttgatgcaggattcactgagaccagtggatagcccctccgaaggtgtcagggcggaaaatgtccggaaata

SEQ ID NO: 78525 - DNA, 338 bp, Homo sapiens
agacgtctcgtccattctggcatacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatggacgtctatgcaagaatggacgtctatgcaagaatggacgtctatgcaagaatggacgtctatgcaagaatggacgtctatgcaagaatggacgtctatgcaagaatggacgtct

SEQ ID NO: 78526 - DNA, 5595 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78527 - DNA, 5593 bp, Homo sapiens
aaaatgccaggctggtaccggacagaggtgttatggatcgcgccgcggaacttgctctaacttcctcgagccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78528 - DNA, 5499 bp, Homo sapiens
tcgcaggtgaggcccggtttatcggacgagggccgggccgcgccgccgctgccgccgccgcgcgcggattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78529 - DNA, 5682 bp, Homo sapiens
aggctgtcgcccgggtagggatgccgggccgcgccgccgctgccgccgccgcgcgcggcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78530 - DNA, 5736 bp, Homo sapiens
tcgggatcgccgctcggagcgggagtcgcgccctcccgccccgcgccgcggaacttgctctaacttcctcggccgagccgggccgcgccgccgctgccgccgccgcgcgcggcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78531 - DNA, 5969 bp, Homo sapiens
tgggcaggccggggttgaaactcttcaccccttgcggtctgtactgcctcccaactgagcagccagggagaaggcctagagcctgtgcctttcagctagatagctggaggaactggctcctccctccttaggctgtgctggcctgagctgggagcctgagagctggggcagttgtctctaaagtggcttctgggattctggtaagaggacttggggtggagtcgaaagcagggagccctgtgagttgagacgaactcttgcaatgttgccttggctggtctcgaactcatcttctgggttcaagctgtccgtctgcctcggactcccaaagtgctaggattacagcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78532 - DNA, 5871 bp, Homo sapiens
tgggcaggccggggttgaaactcttcaccccttgcggtctgtactgcctcccaactgagcagccagggagaaggcctagagcctgtgcctttcagctagatagctggaggaactggctcctccctccttaggctgtgctggcctgagctgggagcctgagagctggggcagttgtctctaaagtggcttctgggattctggtaagaggacttggggtggagtcgaaagcagggagccctgtgagttgcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78533 - DNA, 5735 bp, Homo sapiens
  misc_feature (1)..(1): n is a, c, g, or t
  misc_feature (40)..(40): n is a, c, g, or t
  misc_feature (45)..(45): n is a, c, g, or t
  misc_feature (48)..(48): n is a, c, g, or t
  misc_feature (51)..(53): n is a, c, g, or t
  misc_feature (56)..(56): n is a, c, g, or t
  misc_feature (82)..(82): n is a, c, g, or t
  misc_feature (90)..(90): n is a, c, g, or t
ncccgccgctcggacggcccgagtcgcgccctcccgcccngcgcngcngannntgntctaagcttcctcggccgagccgggncgcgccgncgctgccgccgccgcgcgcggcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78534 - DNA, 5594 bp, Homo sapiens
  misc_feature (1)..(1): n is a, c, g, or t
  misc_feature (40)..(40): n is a, c, g, or t
  misc_feature (45)..(45): n is a, c, g, or t
  misc_feature (48)..(48): n is a, c, g, or t
  misc_feature (51)..(53): n is a, c, g, or t
  misc_feature (56)..(56): n is a, c, g, or t
  misc_feature (82)..(82): n is a, c, g, or t
  misc_feature (90)..(90): n is a, c, g, or t
ncccgccgctcggacggcccgagtcgcgccctcccgcccngcgcngcngannntgntctaagcttcctcggccgagccgggncgcgccgncgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78535 - DNA, 5871 bp, Homo sapiens
tgggcaggccggggttgaaactcttcaccccttgcggtctgtactgcctcccaactgagcagccagggagaaggcctagagcctgtgcctttcagctagatagctggaggaactggctcctccctccttaggctgtgctggcctgagctgggagcctgagagctggggcagttgtctctaaagtggcttctgggattctggtaagaggacttggggtggagtcgaaagcagggagccctgtgagttgagacgaactcttgcaatgttgccttggctggtctcgaactcatcttctgggttcaagctgtccgtctgcctcggactcccaaagtgctaggattacagcgttacatccttactattcaaagtgccatccacagacctgctgatgggcagcatgagcatcacctgggagcttgctgcgctgtagaatcttgaggggtctccatccagatcagctgaatcagagtttgcattgttaacaagttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78536 - DNA, 5507 bp, Homo sapiens
  misc_feature (48)..(48): n is a, c, g, or t
  misc_feature (54)..(54): n is a, c, g, or t
  misc_feature (57)..(57): n is a, c, g, or t
aacaataatgtcatagtagatcctggtgttaatcatcacgagggcggnccggcngtngtgccgcgccgcgcgcggattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78537 - DNA, 5624 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagtgctgccctgctttctctgtctctttcagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78538 - DNA, 5226 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78539 - DNA, 5499 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78540 - DNA, 4508 bp, Homo sapiens
  misc_feature (4378)..(4379): n is a, c, g, or t
  misc_feature (4381)..(4382): n is a, c, g, or t
  misc_feature (4384)..(4384): n is a, c, g, or t
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggannanncntatactctccttggtaggacaaaaaaaacttaggctgtttatttatttcggcccttggaaacacagaatattttctttttcttttagggcataagccttattttgcccttttaagtatcttttg

SEQ ID NO: 78541 - DNA, 3818 bp, Homo sapiens
gacgaaaaactacaatacaggactctttcgaggccctgtaatgggaatgttccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78542 - DNA, 2490 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaattcttgctgtcgtaggaccagtggggaattttttttttttttttttttttttttttttttgggaaag

SEQ ID NO: 78543 - DNA, 2176 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccattccccagcccagggctggggaagagggggtggtgccatgggccacatgctgctgccctttcgcctgggcctgggggtcacccatcagctcaggccaccaattcttccactggatacacatcggggacctgcaggatctgacccatgcaccgtgaa

SEQ ID NO: 78544 - DNA, 4424 bp, Homo sapiens
tcgggatcgccgctcggagcgggagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78545 - DNA, 4246 bp, Homo sapiens
  misc_feature (1)..(1): n is a, c, g, or t
  misc_feature (40)..(40): n is a, c, g, or t
  misc_feature (45)..(45): n is a, c, g, or t
  misc_feature (48)..(48): n is a, c, g, or t
  misc_feature (51)..(53): n is a, c, g, or t
  misc_feature (56)..(56): n is a, c, g, or t
  misc_feature (82)..(82): n is a, c, g, or t
  misc_feature (90)..(90): n is a, c, g, or t
ncccgccgctcggacggcccgagtcgcgccctcccgcccngcgcngcngannntgntctaagcttcctcggccgagccgggncgcgccgncgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78546 - DNA, 3610 bp, Homo sapiens
tcgagctcggctacctttgtcgaagaacaacggcactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78547 - DNA, 3807 bp, Homo sapiens
ggacgcgtgggtcgacccacgcgtccggaaaccttcttcttggtgaacacgatgtccctttaacatgtatgagcaaatgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaagttggctggagttgtcttccttggagtcgggctgtgggcatggagcgaaaagggtgtgctgtccgacctcaccaaagtgacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78548 - DNA, 3512 bp, Homo sapiens
agaagacgtctctcgttaaggggacagctgcaggagtgtaggtgccttgttctggcctccgtgtggaggcagtagtgacaaagagggaggcaggcctggggcaggggcgaggctctgtccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78549 - DNA, 3619 bp, Homo sapiens
aacagccttagatagtgtccatggctggagccgaccctttgagtccccttgagtgtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccgggcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78550 - DNA, 2069 bp, Homo sapiens
caggtaagctggttgaatcggacgaggtcacctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78551 - DNA, 2158 bp, Homo sapiens
ttccttgcagagcagagagggtgtcagtctcatcagggaacccacctgatggcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78552 - DNA, 1592 bp, Homo sapiens
caaagcaaaagaaaaaaaagaaagaacaaagaagaagaaaagaaaaaaggcatgatgagccgtggttaacggccgagggcagaggcacggttaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactaccagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaa

SEQ ID NO: 78553 - DNA, 1682 bp, Homo sapiens
tcgggatcgccgctcggagcgggagtcgcgccctcccgccccgcgccgcggaacttgctctaacttcctcggccgagccgggccgcgccgccgctgccgccgccgcgcgcggcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctgtaagcacctccccagcgggcccccgatagagcatgcacctccctgtgctgcctggagctgagtctagcaggggcatcaggccttctctgtgggttgtctgcctgcagcttggcagacagcagggaggccgtggaacaagccactccacctctggtctgttccactttgccggcttgtggttgcctggtgggccagccctttcccattgggattgggcaggcaagtccagctgcacccgaggccacccaccccccacgtgcccggccctcctctttcggccccagatctttccaatcctgcccaatagccataccagctgcaatcctccttaggcgctgcataccgtaaggcacagcttcttccccccggctcatgactcaccgtctgacgctattcctatccccttcctccccgggaccttttccccttcctgtttaagaagccagggctgcctggaggaagctttgtcagatctagtggaatgtgacctccctggaatatgtgcccaggggtttgtctaagcagttccaggctatggcctttactccatctggtccccatccctcttatctctctcatgtgtggctgcacctggacgcttggaccatagctgtcacagccccctggggaggaacccactccttggccatgtcagcctgtgcaatgcaaggctcttgtttgatctgtgtgctgacagaaagcccagcttccttaagaacttttcatgtggaacactttggttttgagaagaaaataaatcagaaaccattaaaaatctatgattcactctcattattaaccaaaacttgttcacctttatttcatgtattatgggatccagcaaaacccatttatgggaccaaagaccctgcctgtattgttattactaatgtgtattagtctgtgaaagtcaccaaatccccgccatgttttgatgcctctcctttcttttctgttcagt

SEQ ID NO: 78554 - DNA, 1315 bp, Homo sapiens
tcgggatcgccgctcggagcgggagtcgcgccctcccgccccgcgccgcggaacttgctctaacttcctcggccgagccgggccgcgccgccgctgccgccgccgcgcgcggcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctgtaagcacctccccagcgggcccccgatagagcatgcacctccctgtgctgcctggagctgagtctagcaggggcatcaggccttctctgtgggttgtctgcctgcagcttggcagacagcagggaggccgtggaacaagccactccacctctggtctgttccactttgccggcttgtggttgcctggtgggccagccctttcccattgggattgggcaggcaagtccagctgcacccgaggccacccaccccccacgtgcccggccctcctctttcggccccagatctttccaatcctgcccaatagccataccagctgcaatcctccttaggcgctgcataccgtaaggcacagcttcttccccccggctcatgactcaccgtctgacgctattcctatccccttcctccccgggaccttttccccttcctccctgggaccttttccccttcctgtttaagaagccagggctgcctggaggaagctttgtcagatctagtggaatgtgacctccctggaatatgcagtcccacggcttccttatgctatcaccagccatcgctacacccgctctcgattttacagcggccgcg

SEQ ID NO: 78555 - DNA, 312 bp, Homo sapiens
ggcagacttagcctggcatcactatgaatgatgccctatgctgggcagccatggccctgtcttggagcccctaacagttctggcttttgtggttgcagaaccagtgctgtggcgcatatggccctgaagactgggacctcaacgtctacttcaattgcagcggtgccagctacagccgagagaagtgcggggtccccttctcctgctgcgtgccagatcctgcgggtgagttggcttgtgctggggcacagggagcccgcccttcctgaagcccagaagctttcctgactcctccagtgctctaggatactt

SEQ ID NO: 78556 - DNA, 573 bp, Homo sapiens
ggacaaagactgcatttttaggaggctccttggcatcccagaagacgtctctcgttaaggggacagctgcaggagtgtaggtgccttgttctggcctccgtgtggaggcagtagtgacaaagagggaggcaggcctggggcaggggcgaggctctgtcctccaggacttcctttaggctgtagggagtgtgctcttagatgcaaagagaaggaagaccccaccccactccagtccttgttctagtggtctttggtgatatgaatgactgctgttctaaaagggaggagtctcgaggaatcttcagagaccccacctgttagccgtggatatgagggatgtgtccctacagcttggggaactgtcctcctttagggacctgcatttcacagggagaaagtgctgtaaactgaatgtgtgtgtctctccaaaattcacatgttggaacttaaactccaatgtgatggtatttaagaggtggggtcttggggaggggattgggtcatgagggcagagtccttatgagtgggatgagtgtccttatgtaagaggcccagagagcttatttgtcactc

SEQ ID NO: 78557 - DNA, 1705 bp, Homo sapiens
tcgggatcgccgctcggagcgggagtcgcgccctcccgccccgcgccgcggaacttgctctaacttcctcggccgagccgggccgcgccgccgctgccgccgccgcgcgcggcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctgtaagcacctccccagcgggcccccgatagagcatgcacctccctgtgctgcctggagctgagtctagcaggggcatcaggccttctctgtgggttgtctgcctgcagcttggcagacagcagggaggccgtggaacaagccactccacctctggtctgttccactttgccggcttgtggttgcctggtgggccagccctttcccattgggattgggcaggcaagtccagctgcacccgaggccacccaccccccacgtgcccggccctcctctttcggccccagatctttccaatcctgcccaatagccataccagctgcaatcctccttaggcgctgcataccgtaaggcacagcttcttccccccggctcatgactcaccgtctgacgctattcctatccccttcctccccgggaccttttccccttcctccctgggaccttttccccttcctgtttaagaagccagggctgcctggaggaagctttgtcagatctagtggaatgtgacctccctggaatatgtgcccaggggtttgtctaagcagttccaggctatggcctttactccatctggtccccatccctcttatctctctcatgtgtggctgcacctggacgcttggaccatagctgtcacagccccctggggaggaacccactccttggccatgtcagcctgtgcaatgcaaggctcttgtttgatctgtgtgctgacagaaagcccagcttccttaagaacttttcatgtggaacactttggttttgagaagaaaataaatcagaaaccattaaaaatctatgattcactctcattattaaccaaaacttgttcacctttatttcatgtattatgggatccagcaaaacccatttatgggaccaaagaccctgcctgtattgttattactaatgtgtattagtctgtgaaagtcaccaaatccccgccatgttttgatgcctctcctttcttttctgttcagt

SEQ ID NO: 78558 - DNA, 746 bp, Homo sapiens
ggttagtcggtacaagggaggattgggtatacttgatggaggatatagtagatggcattgatttggcgtcagagcaaagagaagagattattacaagtgcaatagaccatgcgggtaactgacataggtttttcatggcggatcaggaaagagccttgagaatgcgagcgatatcagagtctgcgcttgggaaaatacagcactgatgaatccatcacatctttagcagagttggtagtccaaaaaatatcacctagacattcggagcctgttaaaagagttctagcacttacagaaacatgtttagtagaacgtgatccggcaacctataatatggcaacattgaagcctttaggagctgggttggttatgaaggcaataatagaggaaggtgataaagaaattgctacaaaaatgcaggagcttgccctaagtgaaggtgccttacctcgacacttgcatactgcgatgtttacaataagctcagatcaaaggatgcttacaaatagacagctaagtagacatttagtgggactctggacagctgataatgcaactgcaacaaacttgttgaaacgcattttgccgccaggcttgctggcatacttggaaagctcagatctcgtacctgagaaggatgctgatcggatgcatgttagagacaatgtgaaaatagcaatggatcagtatggaaaatttaataaagttccagagtggcaaagactagctggaaaagctgctaaaga

SEQ ID NO: 78559 - DNA, 2343 bp, Homo sapiens
ggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgaaaaa

SEQ ID NO: 78560 - DNA, 2306 bp, Homo sapiens
ggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgaaaaa

SEQ ID NO: 78561 - DNA, 1071 bp, Homo sapiens
tgagctcggtaccagttcgacggagactctcgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgaaaaa

SEQ ID NO: 78562 - DNA, 2610 bp, Homo sapiens
  misc_feature (2358)..(2358): n is a, c, g, or t
  misc_feature (2361)..(2361): n is a, c, g, or t
ggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgaaaaaacaaaaaaacaaaanaanacaaaaaaaaccacagagcacactcccacaagcacgccacaagcgaccagcagtaccgcgacgcccgggcgcagtcaccccaagccgcgccaccagcggcgcaccgctcgcacaccggcgcaccgaccacacccacgcgccagagccggggcacacaacaccggcgggagcggccgcgagcgcccggcacgcgaggcagccccccgcgagccgcggccacgcggccccagcgcggccacggcccgccca

SEQ ID NO: 78563 - DNA, 2064 bp, Homo sapiens
ggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagctaggtttatgccactctggggccttttgggccccacatgacaatccttggggtttattttgcccct

SEQ ID NO: 78564 - DNA, 604 bp, Homo sapiens
ttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccagagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcg

SEQ ID NO: 78565 - DNA, 825 bp, Homo sapiens
gagagagaaaaaaaatgtttcagaggaaggagcccctgccttctggtgaagagtattcaagatgaagataaacttttcaacttaatatcgagactttgatagcagaagggatctactcttgaaagtccaaaaaatgttgttgctataggaacagactcggtgaacaagacatttgagaagagaaggtcaaagacccagctgcacttctgcttcactgctgaacttctgcttcttcctatcagggaatacactgctcctcacattagggatttcctaaaattgttaggtgttttgaacagaactggctataccaatgaggctcaaacaagaatcataaagtgcatggtgcttctctccctctctgttttctttaaaaagaaaacattcttgacaagatgaatacaatattttcattctagcaaatttctgctgtcagaggttatatttacaggatagagagatttctcaaacatgaccttttctcgtgtaataccagagtgaaattttagaaaagtctgtgtgtgtgtgatgcgtgcgtgtgtgtgtgtgtgtgtgtgtgtgtgtgtgtgtctcgcaggctgagaagtgggatgggaagaagggaatgtggctagaatcttaccatctcattctcttctccttcattgagcagagcgtgctggcccttctcaaagtgtcccatgaaaaagttattccacacctcctccctgaccttgtcgtgcagacgcttccaggatgaactccaactcgccgagccaccgcagctcctcagctgactaaaagagttaatgatcctccaggttaaaactcctccttgagcacaca

SEQ ID NO: 78566 - DNA, 1085 bp, Homo sapiens
agcgacacttgtgaagaaatttgctggaaattaatggaattgctgactttttactgtcaggctgcctacctgaaattttggacttagttcttaaaggtaaaaaggtgcaattttgaagtgctcaaaatctgttcttgtatttcataatcaagaacttctgtgtcaagtaagaaatactcttcacacactatattttttttgagggaaacagatagtgctattcagaaatagtcattctgaaatttcttattaattggtcaccaaagggtggacatatagaggagaacatttacatgcatggtgttttaattataaaattaatttttatctagaaatattaaagtaatttattaaatacagactgattatggatttttagcagacaaaaccaattactgtttactctgtgccttgaggccttgctcttttcacatactattctttttttttttcctgagtttcgctcttgctgcccaggctggagtgcaatggtacaatcttggctcactgcagcctttgcctcctgggttcaagtgattctcttgcctcagcctcctgagtagctgggactacaggcatgtgccaccacacccggctaatttttgtgttttcggtggagacaggtttcatcgtcttggtcaggctggcctcgaactcctgactgcaggtggtccacctgcttcggcctcccaaagtgctgggatcacaggcatgagccaccgcacctggccttcacacactatcgtttaatcctcaatatctgtaaactttggtgacacatccatttaaaattcaaaaaaccatcttggcttagcacatgactgaaaatgaaaaaatatcaaggcaaccacaacatgtcatgctttttcttcttttgaaacatcatcacagttgataattggtttactgtttatgacttttctgctagactgtagtctccatgaaagcaggatacttactaggtttttcttattcaccatggtatccccacctagcacagtttccagcaacattgagtagtcagtatgtattaatcaaataaataaaataataaataaataaatgtgttcataatatttattgct

SEQ ID NO: 78567 - DNA, 763 bp, Homo sapiens
agccagcgaggccctgcctgccagccgggaaggaggcgtggttatggagctggcggctgcaaccccggggcccgcgccgctgcctagcgcttcccgggggctctttggggacgcgccccccgccgcggctcggggacccgtagagcccggcgctgcgcggttggcccttctcccgcgccccgcgctcaccctcctgctcctcctcatggccgctgttatcaggtgcctggagcaggcctagaccaccgactggagggccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggcgttcatcttaacattggtatcccttccctgacaaagtgttgcaactaacacgacaggtgctatgagaactgtggcaaaagcaagaatgactgtgatgagaaattccagtattgcctctccaagatctgccgagaagtacagaaaacactaggactaacttagcatgttcaggcatgtgaaacaacaatggagctcttgtttgacagtgttatacatttaggttgtaaaccatatctggacagccaacgagccacatgcaggtgtcattatgaagaaaaaaccgatatttaaaggagatgctgacagctggtgacagatgaagac

SEQ ID NO: 78568 - DNA, 278 bp, Homo sapiens
gcagtatgatcccatgtatggttttaaagatagaagggcaatgcctagcacatagtagacgctcactatttgttaaatgaatcaatgcatggtatataccaaagtgttacactaaagctgggaatacggtggggagagttttatttttcctgctgttttcctttttgcaatagtcatgttattttaacatgacattactgatccttaatgtatctgtctggtggccatacatgctttagaagggccaggagaaccacatggcataaattcctacagtg

SEQ ID NO: 78569 - DNA, 425 bp, Homo sapiens
accattactgtctaagaaggaatttagaaattagaaaagcatattgatctctgagtaaccatgcatgaaacaaatacacaacagaaaagatatgcaaagtcacctttgagatgaactgattgctggctatcctactgtcctcgaggtaatgagtatcagtaaatccaaagaaagtatgtgttgtcacagagggaaggagggtattgttatgtaagcatgccagggaaagaagggcctgaaaagagcccttctgtggcttttatctccatcggaccactatgtatttacctatgaatttcattactatctctctcaaccaaaatgtaactccttaagggtagggactgtgattattgctgttatttgtagagccgcaatgagtacccagcatgtagtaggtgcttattaaatatttgaatgaatga

SEQ ID NO: 78570 - DNA, 119 bp, Homo sapiens
tgggaaggcagctaataacactcaggaaaaatggtagcacccccttctgaaaggaaggcaaccagaatacctcatctagcagcatgtccctggcatctatgacaagcaaatagagaact

SEQ ID NO: 78571 - DNA, 528 bp, Homo sapiens
tcacccctccccttggcggctgcctgcagtgggccgtgtttccattcccctcccaggtctgaggatcccgggctctaccatgttaaagtcggagggctgacaccctcactttcagagccccactcggccttggtggctgtgaggaggctcctggtccactcctcataccatgggaccaccaccagcggggacattgccctgatggagctggactcccccttgcaggcctcccagttcagccccatctgcctcccaggaccccagacccccctcgccattgggaccgtgtgctgggtaaacgggctgggggtccactcaggagagggggaaggggaatatgcactcaccagcccctactcctagtcagggaggacaagcccagggaccacgcagagccagcctgagtggtctccacagacgttggtctgcgtgtttatctcctctcccctcccaccccaccctgaagctgggaacacttggggccaggacccatgctgtccagactgtgggactccccttggccaaggt

SEQ ID NO: 78572 - DNA, 431 bp, Homo sapiens
gacaccatctctaccaaaaaattttaaaattagccaggcgtgggggcacgtgcctgtcatcccaactacacgtgaggctgaagtaggaggatcacttgagcctgggaggttgaggttgcagtcaactgtgattgtgccactgcactccagcctgtgtgacagagtgacatcctgtaaaacaaacaaacaaacaaaaaaccagcctaacatttcttgaggcatctctgacttctaggcccttttccccatataatgaaaactcgtctaccatccaccttactaatgtgacagcaaatccaatgactagaatttatcaagttagcctgttacagttagagaatttaagaatgcttccaaatagacagttgtcaatatatttttctatgtcaacacacttgagaaaatccaacattctcaggggtgtcagtgag

SEQ ID NO: 78573 - DNA, 708 bp, Homo sapiens
agctttgtcatctatgctacactcagaaggaatattaatttcctaagcttattctgatgcagtaactgatgtataagaaaacaacttattttctacatctgcccaggactctcttcccaactttgccaatcaagctcttccacctcttttaagccccagctctaatattccacctcacagtcttttaacctcccattcccccatggccattcttttcagtatacacccatggttcatgcatctacaactgcacaccacactgcgttgtaactgttttttaatgcattactccccctgtcagctctcgatcccatatttgtaggaactgtgtccccatatctgtattttggttgcatccagttgaaagacagggcatggtagaatagaaataacatgcaccttataaactgatgcaggttaaatccaaactgctccttacttgctgtggggactggggcaagttacttctttgagcttctttaaaacaacaatagtaatacctgctatgcaggattgttgtgaagattaaataagctgcattcattagttcaacaaatatatggagacgtcctattacatgtcagtaattgcaagtgtaactgtacttgctattaagaatataaaggtgaataagtcatgactttatcctaagaactttataatgtggtagtagagaaagactaggaaatagacagttgcaacataatt

SEQ ID NO: 78574 - DNA, 448 bp, Homo sapiens
gtggcttctgcttctgagaaggcctcaggaagcttccaatcaaggtagaagacacagagggaagaaggcatcgcacaaggcaggagcaggagcaagagagagcaagaggggaggtgccacacactttaaacaaccagatctcataagaactcactcaccatcacaaggacagtaccagatggtgctaagctggtcatgacaaaccaccctcatgatacaatcagcttccaccagaccctacctccagccttgaggttacagttagacatgagaattgggcagagaaatagatcccaactatgtcacctactcgtgtaaaacaacaacagtaacctgaacgtgttaactgtaccaaaatttcacaacagaatggtcaaaatgtccatggtataattcaaatttatctgacatacaaaaaagaatgaaaatgtgatcagttttagaggaa

SEQ ID NO: 78575 - DNA, 617 bp, Homo sapiens
gatcttcaggatcacttgctgcagctctgtgtaccccttactgcttccagttgcacctttatattatggagatgacttcttcccttaaaccctcataaacccaacctctgctggcgtcagatttttcttctgcagcttccttaccactctcagcctttgtagtgttgaagagagttagagccttgttctggatttagcctttggcttaaggaaatgctgtggctggtttggtcttctatccagaccactaaaactttcttcacatcggcaataagactgtttcgcttccttattattcatgtgttcactggattagcactttgaatttccttcaagaactttcctgttgtattcacaacttggcttttaccctgaattttatggtaattactttcttgctttcctttatagttttataacctaatattctataataaatatattttttatttttttgacttcatataaatggcatcatatagtagtagaaatagaatgagaaaagtttcagtatgctaacttatgaaaaacagtaaattttatattaatttttctttttataatttatgactcaggtttcaattcatcagttaaaatatgtcacttcatgctcacac

SEQ ID NO: 78576 - DNA, 329 bp, Homo sapiens
ctttgtaatagaaacttttaagaaaagatttcatctttgatgactgtggaatagccctttttttttatctgttaaagtatttggtttttttttttgtgatgccacagccaagaaaactgcagtagtaatagtatgcaaaaagatgtaacattctctcttcatcttactgtttaacttcaaagcattcttgtgaacagaaaccagttaggactatagaacaagatgccaaaacatgaatgactctgctgaagtcaatgaaatgcaattacaaagtgcagtgctaactttgaattgaatcagaggggccactaaaaaacagtaattagcct

SEQ ID NO: 78577 - DNA, 266 bp, Homo sapiens
atactttaaatactttaaatatatatatttaaagtatgttaataataaatatactttaaataattatataagattgcttataatacctaatataatacccatacatcacttcatgcaagtggatacgatgtagtacttggtgttgcagcaaattcaaattttgcttttcgcaactttatggaatttttttcttctgaatatttccttagttgaatccctggatatggaactcacggatacagagtgccaactctattttcgctatt

SEQ ID NO: 78578 - DNA, 476 bp, Homo sapiens
gtagcaaaatgagatcccagataagataatgtttcaccttgaactcagcctgttcttaggagggttatgtataaataagggttgtaggtttgctgaagctgtgggtgagtcaaagttcaggggctgtttggaagaagagaaacaagcaaagtttctgtaaagagtatgttattttgaccactgaagactaaattactgaatggttgttcatttttaaaaatgggaatttgcaatctgtgtccatttttgtgataggttaaaaaaacagcagggagcatcctcaaagtcatcacgggaagcacgtttctcttcactaagctgttctttgagaatgcaaagaatgggggaatttctttaaatatagctatttccaggattaccttcacccacaactgttccttgccctagacatctcttccatttggctgtttctgagttatatttttataataaagtagtaaatataattacagtta

SEQ ID NO: 78579 - DNA, 1279 bp, Homo sapiens
ctccgcgggcagccaacattgatttcctccgggccgagggcgagggcccgggcggcggcgggctgcagccgcggcagggcgagagcatgtccaagccggtggaccacgtcaagcggcccatgaacgccttcatggtgtggtcgcgggctcagcggcgcaagatggcccaggagaaccccaagatgcacaactcggagatcagcaagcgcttgggcgccgagtggaaactgctcacagagtcggagaagcggccgttcatcgacgaggccaagcgtctacgcgccatgcacatgaaggagcaccccgactacaagtaccggccgcggcgcaagcccaagacgctgctcaagaaggacaagttcgccttcccggtgccctacggcctgggcggcgtggcggacgccgagcaccctgcgctcaaggcgggcgccgggctgcacgcgggggcgggcggcggcctggtgcctgagtcgctgctcgccaatcccgagaaggcggccgcggccgccgccgctgccgccgcacgcgtcttcttcccgcagtcggccgctgccgccgccgctgccgccgccgccgccgccgcgggcagcccctactcgctgctcgacctgggctccaaaatggcagagatctcgtcgtcctcgtccggcctcccgtacgcgtcgtcgctgggctacccgaccgcgggcgcgggcgccttccacggcgcggcggcggcggctgcagcggcggccgccgccgccggggggcacacgcactcgcaccccagcccgggcaacccgggctacatgatcccgtgcaactgcagcgcgtggcccagccccgggctgcagccgccgctcgcctacatcctgctgccgggcatgggcaagccccagctggacccctaccccgcggcctacgctgccgcgctatgaccccgcggggccgcctcgcgaggaccggtgtgcacacgtgtacatatgtataggtacgagcgctgcggcctccccgtgcgccctcccgcgaccgggggcccggtttgtatgtacatagaatgtataggtgccaggtagaggcagagaggccaggcggggcaggagtggccaagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagtt

SEQ ID NO: 78580 - DNA, 781 bp, Homo sapiens
tcaggaaaaaaaatattcctacttaaattttaagtctataattcaatttaaatatgtgtgtgtctcatccaggataggataggttgtcttctattttccattttacctatttactttttttgtaagaaaagagaaaaatgaattctaaagatgttccccatgggttttgattgtgtctaagctatgatgaccttcatataatcagcataaacataaaacaaattttttacttaacatgagtgcactttactaatcctcatggcacagtggctcacgcctgtaatcccagcacttgggaggacaatgtgggtggatcacgaggtcaggagttcgagaacagcctggccaacatggtgaaaccccgtctccactaaaaatacaaaaattagccaggcatggtggcgtacacttgtaattccagctactcaagaggctgaggcaggaggattgcttgaaccctgaaggcagaggttacagagccaagatagcgccactgcactccagcctggatgacagagcaagactccgtctcaaaaaaaaaaaaaaaaaaaagcaagagagttcaactaagaaaggtcacatatgtgaaagcccaaggacactgtttgatatacagcaggtattcaatcagtgttatttgaaaccaaatctgaatttgaagtttgaatcttctgagttggaatgaatttttttctagctgagggaaactgtatttttctttccccaaagaggaatgtaatgtaaagtgaaataaaactataagctatgttaaatacatttt

SEQ ID NO: 78581 - DNA, 3769 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78582 - DNA, 3552 bp, Homo sapiens
tagctagtagaggccccgtgttgatcggacgaggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78583 - DNA, 4610 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaaaaaacaaaacaaacaaaaacaaaacacacaacaaacaacacaaacaaaacaaaaacaaacaaaacaaacacacaaacacaacaaacaaacaaaagagatgctgtggcgcgccgcgcgcgccgcgcgcgcgcgccgcacagcagaggatcgcgatcttctctatagacacacacaacatgctctgcgtgtgtggcgcgcgcgcgcgcgcgcggcccccccaagcagggagccgtgagtgaagagagagagagacgtggtgccctcactaggggggcgtgctcctgtccgagagagcagagacagcccgcgcgtgcagccgtaaacaaacacagagtggggggcgagtgtagcctctccccccaaccacacaaaaaaacaagaacagccgcgcgcgcgcgggagagagcaccaaagaagcgctggggggaggtgtgcagagagacgcacaaccaccgctctcgcgacggcgcgggggtgtggtatcgagagagagggagtcaactaactcggtgggcgttgcgtactctaatagccaggggaggggacggccacacagcggagcgagcgacggccccgcgatcaaataagaaattatcccgcc

SEQ ID NO: 78584 - DNA, 3377 bp, Homo sapiens
tcagctcggtaccggcttagaagctggcaggtgacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78585 - DNA, 3834 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78586 - DNA, 2799 bp, Homo sapiens
  misc_feature (38)..(38): n is a, c, g, or t
gctgtattttaatatatctcctccacaagagctgagcnctccttaagagcagggacttcccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78587 - DNA, 1924 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaatgcactactccaacaacttacccacaacacaaccgag

SEQ ID NO: 78588 - DNA, 2390 bp, Homo sapiens
attaaatggtttggctaaggttgtctggtagtaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78589 - DNA, 2517 bp, Homo sapiens
  misc_feature (116)..(116): n is a, c, g, or t
  misc_feature (170)..(170): n is a, c, g, or t
  misc_feature (191)..(192): n is a, c, g, or t
gaatcccagcactttgggagcccaagggaagagtatcccttgagcccaggagtttgagactagcctgggaaatacagggagaccttgtctcaaaaaaacatcccacaaaaccatgnccgggcacggtggttcatgcctgtaatcccagcactttgggaggccaagggagncagatcacttgaggtcagganntcgagaccagcctggccaacatggcaaaccccgtctttaccaaaaatacaaaaattagctgggcatggtggtgtgcacctgtagtcctggttactcaggagtctaaggcgggaggattgcttgtgcctgggaggtcaaggctgcagtgagccatgattgcgccactgcacttcagcctgggcaacaagagtgaaactccgtctcaaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78590 - DNA, 1270 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggataatcgtatatttttgccttgttatctagatcttactatatggatattctattttatataatagatttattacattctaattcttgatttgttgtatttgtgtcatgtatattattaattatctttatttatttttgaggtta

SEQ ID NO: 78591 - DNA, 4009 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78592 - DNA, 3896 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78593 - DNA, 3558 bp, Homo sapiens
aaggcatacggacgaggacgggggttaatcaggagaggggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78594 - DNA, 3866 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78595 - DNA, 2928 bp, Homo sapiens
agagcatccccccgtgagacaactttagaatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 78596 - DNA, 2729 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgccctttttaattaattcctttaatggctggcacaggtggggtgggactatgggtcccagagatttcctaaaattcggggggtcccatttggtgggcggccaataaatctggggttcaaaagggtcctctccacattctcaaccaaaattgggtgcctccggttaacaggagaagggctaaaatctgcggggcaaatgggctcccctatggggccgaaccccataatagtaacataatcagatttttaatataaataccgccccccaaaaacctccttttttgtgtctttttggggcccaaaaaaaaaaggcggctgtgtggagacccccttcttcccgggtttgcgcggccccactctgtggggcggaacaaatctttctcacaaaacaccaatgcgcgcacagcaaaccagcggggg

SEQ ID NO: 78597 - DNA, 242 bp, Homo sapiens
gctgcagtgaaaaacatgtcccagttcatcggtgaacagggagtagaatatggacagtattgaataatgccagatactaaaggaagaaaacgtgcgagaaaccctcttgtttatacaggatagtaacattttcttagccccatcttcgtatggtgccgtacacctgaaatgaaactagatatgtctttaatttgaagtcaacgattatgttacaaaatagaaaatcgagtcgcttaaaaatc

SEQ ID NO: 78598 - DNA, 86 bp, Homo sapiens
aggtgcctcgttagcgcagtaggtagcgcgtcagtctcataatctgaaggtcgtgagttcgatcctcacacggggcacaataattt

SEQ ID NO: 78599 - DNA, 305 bp, Homo sapiens
attcgcggccgagtagacttttatttttattttctctgggaatactaacatttatgtaactctgcacaatggtcttctatcttgagttagaatattggtcaaaaggaattgaactttagctttcagcaggtcagggccatcacgtggcccatcgccttcatctcctgctgttcacattgatggagtacaggtgattgcagggagaaaaatatcttgttttcttcctctgctgggaacacacagaacccccaaaacattgaaagtcaccttttactttggattcttgcaatacaatccgtcgacgc

SEQ ID NO: 78600 - DNA, 628 bp, Homo sapiens
agcggaacatgggacttccacagcaatgggatttccttccgcattcagtttgtgcctttcccatgagcgagagactcctaggggagccgcagcccgttaggaagccatgtgggaactcatccacagactggactctgaaacgggcatgtacagagaagaggagaccccaacacgcttcaagctttgagtggagaggacacagcctctgctgggacagggaacagagggatgcggagaccctgaagatgcttttggacagtggtctgaggttgggacagtggcaggagataccattcacccaggatctccaggacaagagatcagcctggcagttacatgtgttttttttcaaactggttgccaggttggcatgagcgatgacatcagagattccgaccttcctgattggagggaccggactctgtcggcacctgggagttcagttggacaacagtaacttctcagagctgttctccactcctgacttctcccagcctcgagaattgataacacactcttctggatcccagcagtgtccagaagaagaccaaggacagaacagagactaggttggtgagatgggacagatttcgggaaagatcatgatgagccatcaaccgcagccgca

SEQ ID NO: 78601 - DNA, 453 bp, Homo sapiens
gagaccatgactttcaaggatgtggaggtgaccttctcccaggacgagtgggggtggctggactctgctcagaggaacctgtacagggatgtgatgctggagaattataggaacatggcttccctgggtaagtaatcgatatcctcatgcttctatccatctttatttctgccttcttgggttgttctgtgctgcatagaaaggtacctgacctggttttagatcctggctctgtaactgctgaccagatcacttaatctagcaccttggtagcctcttttgaaaaatggggagaataatgcctgccattctggattattgtaaagattaaaggtggctgggtgtggtagctcacacctgtaatcccaccacttcgggaggcccaggtgggaagattgcttgagctcaggagtttgagaccagtctgggcaacatagtgaaaccccatctcta

SEQ ID NO: 78602 - DNA, 1705 bp, Homo sapiens
gggagccgccgggaggtaggcgcgggacgggcggctgcggtggcggcgggtggaccgattgtcgctcggcggcgggagtcggtggagtctcgctctttcgcaaggctggagtgcaatggcatgatctcggctcactgcagcctccgcctcctgggttcaagtgattcttctgcctcagcctcccgagtagctgggactacagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggacccgggccctgcccagagcccagatgtgcattggatgggtacaggagccctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagagtaaaacaaacaaattcatcttaaatcaggaacctttggaagaagcagaaaccttagctgtgtcatcaggatgtcctgcgacaagtgtttctgagggaattgatcgatcgatcctcagagaatcttttcaacagaatcagagcagggacaagatgagggacctcagggagggacagatggagccccccaagtctgaactcataggctggggaggaggagaaacttctaggtgggttcgagggggtgcgagcccacctccagccctcagccctcttttccgcataacttggtcagggcacaaggacttgaaggacttgaaagtcagggggttgagaggactggaggcgcctcgagtcaatgtctgggaaacagaggctaaccaggcagcctccacccctggacccccagcc

SEQ ID NO: 78603 - DNA, 823 bp, Homo sapiens
ggaatgcagtggtgcaatctcagctcactacaatctccacctcctgggttcaagtgattattggtccttagcctcccaagtagctgggaatataggcgcacaccaccacacctggctacttttttgtattttttagcagaaacgaggttttgccatgttacccaggctagtctcgaacttctgagctcaagtgatctgccctcctcagcctcccaaagtgccaggattacagacgtgagccagcatgcccagctgctactgattttagtacattgacgatgtatcctgaaattttactaaagtcatttattagttctaggagccttttgtcagagtctttagggtttataggtatagaatcacacagtcctcaaagagagatagtttgacttcatcttttcctatctggataccttttatttctttcttttgcctgattagtctgtgtaggacttacagtactgtgttgaataggaatggtgaaagtggtcatctttgtcttgttccacttctcagggggaatgattctagcttttgcccattcagtacaatgttgaccatgagtttgtcatagatgacttttattttgaggtgttccttcagtgcctagtttgtagagagtttttatcatgaagggatgttgtattttattggaagttttctatgtttatttcgatgatcatatggattttaaattatgtttatgtggtaaatcacatttattgatttgtttatgttgatccagtctttgttgcggatttttgcattgatattcttcagagatattcatcagagatattcatcagagatatttatcagaaat

SEQ ID NO: 78604 - DNA, 415 bp, Homo sapiens
tacccagattagaccaactcctcagggtgcagacaaggtgacgtcaaaggacacagttggactgggattcattcttacaatgggataaggcagggcttaggcccctgtgagaaagaaccaagtactggttcctaaaggaaaggtatgaaagacgggaatgcaaaccctcatggagccccagggccccttgatagagaattctcacatgcccagctccaccactgtgccacaaagccttccagaagcccaaccatcaaggctgctgagagattcctctccccggcgtggctgacaggggtgttttccccggcatggctgacggggttgttttcacaccaggagccaccagcccactgctcagtgataaggagcactcatgaactctgcacacgagcaccctgaaaaaacccagagg

SEQ ID NO: 78605 - DNA, 440 bp, Homo sapiens
gtcttagaatgaatgagtgagacagaaacacaagtctgtctgattctagagtcctgtttttttctttcattctttccttttgaaaaaattccctttactacttctgcatttgatacaaagtggtatctggtaaatgggcctgaaaactttctaaataactagttttaaataatctctgtggaaatttatacaaacaaaaaacttccttgaaaaagtataaactccctcttccagtaggctacgacagactctcaaatcatccgcttcaatcatttagagctgccatgtgcctttggcctcctggttaaaactacatagtcagaattggaaatacaggtagctattagtaggaacaaagacagtgaatgtccaggacagaactgagctgcatttctaggtttgaatggaaccagtaataaaagtccaaaataaatgatcac

SEQ ID NO: 78606 - DNA, 470 bp, Homo sapiens
ggactcgaaatgcgtggccaccctaatttcagctaaatctgagggtggggagattgccaactcaaaaagctgtctgagcctaatcaaggttcttaaaggactcagtcactaggcagagaccgtaccaatttcattcactgctggggccccatgccccagcactagcactgcctgatacacagccagcacttaacatatgaatgagtctgtcaggaaaggaataaaccagatgggtagggtggactgcagcagtgagctactactgacttaactagtcagtacagttaagctttactatttcattcacccagtctggctaactgctctccctttttagtaactgttcctcaatacacacatactcctcctttggttctctgttaaacaagactcagatattcaaagagccaagtaaacctctaagggcttcttttgcaaaataaaagctcagttctggcgttgaactttca

SEQ ID NO: 78607 - DNA, 694 bp, Homo sapiens
  misc_feature (665)..(665): n is a, c, g, or t
gtggagggtcgcggcaggaacaagtgcgggggcctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagctgtgtgtgagatgatgtgacatgacctgnccacattgtgttgcattgattgactgctg

SEQ ID NO: 78608 - DNA, 1399 bp, Homo sapiens
  misc_feature (1361)..(1361): n is a, c, g, or t
  misc_feature (1381)..(1382): n is a, c, g, or t
gtggagggtcgcggcaggaacaagtgcgggggcctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcgtgcctagccanggaagccatggagtaaatgnngggatcctctagacagc

SEQ ID NO: 78609 - DNA, 1568 bp, Homo sapiens
gtggagggtcgcggcaggaacaagtgcgggggcctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccaggctggagcgcaatggcgtgatctcagctcactgcaacctccgcctcctgtgttcaagctattctcccgcctcagcctcccgagtatactgctgggattacaatttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctcc

SEQ ID NO: 78610 - DNA, 1466 bp, Homo sapiens
gtggagggtcgcggcaggaacaagtgcgggggcctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctcc

SEQ ID NO: 78611 - DNA, 442 bp, Homo sapiens
  misc_feature (404)..(404): n is a, c, g, or t
  misc_feature (424)..(425): n is a, c, g, or t
cagatttgctggccccagaggggcaggaggggctggcaaggcccgttccagactttgctaaccctgccttcccacaggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccaganggaagccatggagtaaatgnngggatcctctagacagc

SEQ ID NO: 78612 - DNA, 397 bp, Homo sapiens
ctttgcctcccttgtactccagggttgagatgaagtcaggggataaactgctgggttctcttttcaatcactcactgattaatcatgtaagctcgggagagctctttactactcctaacttgctcttctaggtattgaggaagtcattgtaccagaagttgatgctccggcttggattcaaacacctatcactaaaattgtttgagcacataccatatgtatatatacatacacacacacacacacacacacacagacacacatacacacacacataaattatgtgtgtacttctgtactaaatattttatgtatactgtaatataatgaaacaaattttaataagatggaataaacataaatataaatacaagccctaatatgctttttaaaaaat

SEQ ID NO: 78613 - DNA, 384 bp, Homo sapiens
aaaaaaagaaaaagaaaaaaaaatgggcagagcctaagagacctgtcagacatcatcaagtagaccaacatgcattgtggaaactttaggagaagagagagagaaaggtgcagagagattatttgaagaaataatggctaaaaacttcctagatttgatgaaagataggaatataaacatccaagaagttcagtgaactccaggtaggataaactcaagtgagatcttgccaagaaagacacattataatcaaactgtagaaagccatagacagtgagagaatcttaaaaggagcaagagagaaacatcttgtcacatacaaaggatcctcgtaagattttagaagatttctcatccgaaacattagaggccagaaagcagtgg

SEQ ID NO: 78614 - DNA, 748 bp, Homo sapiens
gagtaaactgctctcttgcttaagccactattatgttaggattttttcaacccatagtcagagatagtcctaactgattcaccaccctcagagagtttacagccaattatgtttctcatgaaaaagttagccagtggttgtaagtgatcccggactggagcgccagtctgcactaaagcagttcgtctgtgggatggctctgtccttgtcaaggagaggacccctcctacacactggcttgttaccacaagtacagtggtaactaagcaggtcggcataggtgcccacagagcagactgaacaccccgtttgcttccctctcctctccgaactccctggacatggccaagtagcataagccaagcagaggtgagaaggagagtggggcacaggcaagttaccagtgggcccgcggctatcatggacttccagaaaataaaaaacaggcatgatggtgttggtttataaaccaaagcagagggcactggagccccgtaagtgtgcaggagtgaatgtatgtggcagggagaagggtagaagggaggaggtcgggtagaaggctacctctaccagctggaaatgagtggtgaagtcagctggacttctgggtggggcggggacttggagaacttttctgtcttacaaagggatcgtaaaatgcacaaatcagcactctgtagataggatcgtaacaacgcaccaatcagctctctgttggctagctagaggtttctaaaatggaccaatc

SEQ ID NO: 78615 - DNA, 463 bp, Homo sapiens
gcctccctggcatgagcttctcgggcacgtgcctcctgggcctcaagctgctcccgccgaagctcccaatacaacaactgtttctggatggtcactagccgttcttcctctgtctccattgccccaggtggccgggaggacaaaaagggctcaaagtttaagaaggggtcaaacatctcagagcttcgaccatggaggtcataaaggcagtcatctccaggtggagagttctcaaggctgtcatctggctcatagaactcatatagggcatctccactgtagctgtctcggggtagacaatccctgcggacaagccccagggcctcacctgaatcatcctcaaatccaggtgtggtggagtcataataaccttcatcactattgggggcggattcttgctggtcactctgaggagtcaaaagttccccaggggctaggccaggataagacctaactgggtcaa

SEQ ID NO: 78616 - DNA, 5485 bp, Homo sapiens
atttatattcattttttactcttttccatcaaaacataattttactaagtacgcatgttctgtgtccgtgttttgtcatcactgaagccacttttggagtcacctagtaatagcctttccactctatctagttctgtagcttttatgtgtgtaaattacttcaaatctgtttatgatcctattgctggaaactttatcccaagacacaaaaatcttttctattagaagttattaactttaaaacaattatttattttattttattttattttttgagacagagtctcgctttgtcacccaggctggagtgcagtggcacgatctcggctcactgcaagctccacctcccgagttcatgccattctcctgcctcagcctcccgagtagctgggactacgggcgtccgccaccatgcccagctaattttttttgtatttttggtagagacaaggtttcaccgtgttagccaggatggtcttgatctcctgacctcgtggtccacctgcctcggcctcccaaagcgctgggattataggcgtgagccaccgcacctggcctaaaacaattatttctttaaaaaaacataccctctattctattttgtgtcttcacaacacaatcacttactgtattgctttttaaagtgatctttaaagagtcttgcagaagagactacacagcaggcccgagaccatcctgagaggcctgtgtgcaaggctggccccccgctgtgtcaggacggtgcccaccaccctcaatgaagaggggctccctgtgcttagctgcttgtgtggggaacaagggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctgaggacccaaaaaaaagcc

SEQ ID NO: 78617 - DNA, 2909 bp, Homo sapiens
attcttctgatttggtagaggaaatagtttaaaaatgatctcacagcgtgatttatgtaaacggcgcttctttctttggatgagacaattgagatagagtctgaaaccctggcaagccacagcttcctgcagtgtcctgttgccatgggttacgaagggagcgagagggaacttcatcggaaatgcctttaaacttttctcacacgcacaagctgcggtgttgaatggtgtgtcttagacccgggtgcctagtgtggctcggtgccttacaatgaatttggggaaagagttgtcaaacgaaacccatgtttctaatgaccagcagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctgaggacccaaaaaaaagcc

SEQ ID NO: 78618 - DNA, 2692 bp, Homo sapiens
tcagggctcccgttggggccgccgtggcttcctgttcttttcggcttcctcctggctcagctgactgtctcgagttctcggcctcctcctggtcacgctggccttccgtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctgaggacccaaaaaaaagcc

SEQ ID NO: 78619 - DNA, 5573 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatcactggactggcttacaacttttctttctcatttgaaactttgtttccactttagaaaataataaaagtattttaatc

SEQ ID NO: 78620 - DNA, 3469 bp, Homo sapiens
tgacttgtctgttcttgtccctggtgcctttaagccagccaccctgctctcctccagccccttccactgttccaagccccttcctcggaggcgtctccccaaccctcctgctggtggccgctcttgcactgcttggtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78621 - DNA, 3363 bp, Homo sapiens
cttttggggtctttgctcttttggggtctttgctcttttggggtctttgctcagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78622 - DNA, 5343 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78623 - DNA, 2963 bp, Homo sapiens
cccggtccagatgctccagctcacgccgaggacattgttcaaaggagcagcggctccagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78624 - DNA, 4045 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctgaggacccaaaaaaaagcc

SEQ ID NO: 78625 - DNA, 3542 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggtcctgccctggggaagctgggtccggccagcagccttcggagatg

SEQ ID NO: 78626 - DNA, 2904 bp, Homo sapiens
gacgtttccattggaacgatgtgcatggggagctgtgtatagagaggacagggtgctggaacccagagccctgggagggagtggtcctcacagggcagcttcagtgggccccgcaggacagccctgcttctgggtggagaagcccagatgtgccttctgagcacgatggcccttgaggcccagagctgagagaatgatgaccgctctctcgtgttaattcacaaaacccagcacctcaggcagtgtggactgagcctgagatgtgtgcacctggggagctgcaggtgggaccgtggcagggcgccagcctccccagcacgtgcggcctgggccagctgggctgctctgggaggtgccccgcacccctgtgacgctggttccctcacggctgcttgtctcgctgctccccagtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78627 - DNA, 2119 bp, Homo sapiens
ttaaattgaaagcccaggccagagagtcccacagtttcctactcagacggcatcagcgcgtaaccgtgttgagtcaagcgtctcgtttgttcaagtctggacctcacacagcgtggtttttagggagtacacagctttttcagactcctgaagacagagtatgctagaagccccagggctgtcccttccgctgtctgtgggaagatagtgtggacggaaaagggctcttgttgacccacagctgatagggtgttaggacagcccaggatgagagctttctagaatgttctgcggtgacagtcattaatgtgaaactctctaaaacacggtcactctgggttttcttccaatagagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78628 - DNA, 1305 bp, Homo sapiens
  misc_feature (25)..(27): n is a, c, g, or t
  misc_feature (29)..(29): n is a, c, g, or t
aaacaaggctaggtacgaggctggnnntncagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78629 - DNA, 2805 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaatccccctccatccgtcttggtggacacctgtgtggctctcacctgcgttttgagtctgttcttccaggagtaataaattctggacatcatcactggactggcttacaacttttctttctcatttgaaactttgtttccactttagaaaataataaaagtattttaatc

SEQ ID NO: 78630 - DNA, 407 bp, Homo sapiens
ggcggggaactggactcactcagccttctcaacgcacgtctgctcggagatcatttgggagatccaagagattcagtatcactcgctcccttgatgatcttgaggtaatttaattttcatttttcttcttttctccttcaagttttaaaaaatgcaagtccaccttgcagatacgtctggctgttttttgagtccctgtggtcccctcccctcctcctctgtagtggtaacccctgttttctgggggacagcgtcccatgcacatttgggaacctttctaccctgcaatgtgtctgagctgtcacagggctttctggggtgctcttctgtgtgccagactccagtgaacacttctagaaatgagctggtttaatccccacaaatactctacgaggtagggcctgtca

SEQ ID NO: 78631 - DNA, 3559 bp, Homo sapiens
cgagtatggccctgggtggcgtcatggcacacaggcactgagtggactgttggtggctgcccccgagtgtggtcctgggtggcgtcacggcacgtgggcactgagtgggctgttggtggctgcccccagtgtgtgtgtcacttacagggcatgatgctactgaagtttgtgaagttggtttcattgacgctgttactaagactgtaatgtcagacatgttgggatctgttcttttcacatgaaaaggatgacttcctcttgttgggtgtcacctagtttgggcggagtgggagccgtgactcttgactcattgggccgtctggctttcccgggacacctccacctggagagtgcctctgagaacctcccagagtctgccccttgtgttcctcagatggacttttcgtttcctggagttttgtcatgaggcttaattaactcatgtctctctctcttttctttcagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgtgagtagggaagggcccaggagcagcggagcggtctgtgctctgcagagactaccgagcaggatctgtgggccgccctagagacagcggcaccctgcgggccctgagcagccccgtggcaggggtctcccctccctggaccgccaccctctcaagagctcagaggagggtgggttgaatcctgcccctggttctgcccccagggagcgtccctggccctcccgctctctactggggtctctctgcagcccgcagcactggagcttcctatctgtgttaagaagccaggtgcctgttgccagctcttcaaagagatgttttgcttttggggaaacagctggaagcagcagtgcggttccctaaagtgctgggcagcgatgaggtttctctctccaggccctcgggcagctcactgagcagccagtgaccccgtggtttctgtagaaggggaagtaggaaaaaggaggaccctgtgtcagtgttaataaatggtgtctttgtctttcttaggattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctgaggacccaaaaaaaagcc

SEQ ID NO: 78632 - DNA, 5497 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78633 - DNA, 5358 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78634 - DNA, 3619 bp, Homo sapiens
agcggagtcatttcctgcgccggagttggttgggtcttcagacaccagctgaatgcttagggattctttcatttcctaaagtgcttacaaaattatgaaaaagcacgactttgctgaaaacctgccttcatctttactaatcatcatactagtcatctttactctcagtggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78635 - DNA, 3341 bp, Homo sapiens
gtgctctgtgtgcacatgctcctgtgtaagagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78636 - DNA, 3798 bp, Homo sapiens
cgagtatggccctgggtggcgtcatggcacacaggcactgagtggactgttggtggctgcccccgagtgtggtcctgggtggcgtcacggcacgtgggcactgagtgggctgttggtggctgcccccagtgtgtgtgtcacttacagggcatgatgctactgaagtttgtgaagttggtttcattgacgctgttactaagactgtaatgtcagacatgttgggatctgttcttttcacatgaaaaggatgacttcctcttgttgggtgtcacctagtttgggcggagtgggagccgtgactcttgactcattgggccgtctggctttcccgggacacctccacctggagagtgcctctgagaacctcccagagtctgccccttgtgttcctcagatggacttttcgtttcctggagttttgtcatgaggcttaattaactcatgtctctctctcttttctttcagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78637 - DNA, 3708 bp, Homo sapiens
cgaccccacactgctcgcgtcaggagggacgggggcgcccccccacactgctcgcgtcaggagggacgggggcgcccccacactgctcgcatccagtggacaagggtgatgaacggggatttcctggggacctcccttctctttattcgagagctcaggagatactgggaaccaaaggctactgagggccgttttgcagacacgtcaggcaggatccggtgtcctgggagcgcgctgtgccatatcccacatcgggtctcctgtaaatgagccgccgagccgacatgcgtggctgagggcttagctctggacactgtgcctgagagtttcgtgttgagaaggagcccacatgcagagcagtgtgcagtcacgggtgtgtgggcttcgcatccggaagagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78638 - DNA, 4002 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagagggtatgtgaactttttaaaacttccacgtttttagtaaatgcacagttagtttccagtatagtcagtagatctgctttgagctgtcagcatctgggtgactgcggtccgtccctgtggcctggaagacatgtttctcccgggggcagtctgtgggctgttgggatcactccaccgaaaccccagttttgagactgagtgccaggcctcctagggcatcaggggcagccgatgtgagcagcactgtctgccctgagatgccagagcccccgca

SEQ ID NO: 78639 - DNA, 5515 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgtgctgatctctgccctagagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78640 - DNA, 4217 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccacaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78641 - DNA, 2920 bp, Homo sapiens
acatgcacctgggtctgtgctgtgtaactgcacgtactgatgtgatttgttgggcacctgccatgagccaagcatgttttggagccaggatgtggcagtagacagggcagagagtagcatctctgctgcatggtgggtagagccttgttggtccctgactggcttccagggttaggaagacacatgtgactcgtctccaccagagacggcaaagtgatgcctggtgggggatgggtggggggggcttcctggcgtctgtctgctcagcctaaagggggcagagggttgggagatgtgaccgaataaacagggttctgattgacgtgagtcactgtgtttcccctgtcaagacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78642 - DNA, 2864 bp, Homo sapiens
gagaaagaaaatatgtcataaatgtaagactctgactttctagagaatatttatgccaaatagtatatgaaatgagcttttcaatttcaacatcactcctccagcaagtccctggttaggaagacacatgtgactcgtctccaccagagacggcaaagtgatgcctggtgggggatgggtggggggggcttcctggcgtctgtctgctcagcctaaagggggcagagggttgggagatgtgaccgaataaacagggttctgattgacgtgagtcactgtgtttcccctgtcaagacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagtccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatca

SEQ ID NO: 78643 - DNA, 2996 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacggtttgtggggtggctcctgggctgtggtgtccaggccaggcagccgcgtccccgtcctggcgtcgctct

SEQ ID NO: 78644 - DNA, 2722 bp, Homo sapiens
ccgttgcgcgcgcgggcggtggcgcgggccgaagcgcccggagcgggagcgagcggcgcggcccgggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcggagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtggtccacatgtgccaggagatgtgggaatggctacccctgaagtcatatggagaaatggggtcctcatcgcacaccatacacaaacatcatctcacaaatggattaaagacacttaagacctgaaaccaaaaaaactcctaggagaaaacacaggggaaagctccatgacatcagtttcggcaatgatttttttttggacatgacactaaaagaacaagcaacaaaactaaaagtaaacaggtgggattacattgaagtaaaaagtttctgcacaacaaaggaaacaaccaacaaaatgaaaaacgaacctgtgaatgggagaaaatacttgcaaactgtatatccagtaaggggttaatatccaaatacataaggaactcatacaactcagtggcaaaaaccaaataacccaattgaaaaatggcaaagagccatagtagacatttttccagagaagctctacagatggccaacaggtatatgcagaggtctcagcatcacccatcaccagagaaatgcagtcacaacagtgagctgtcactgcatgtctgtagaa

SEQ ID NO: 78645 - DNA, 1693 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtagggtgtccttgggtacatccaggagtcttcattgcttctgttattaccccgtctcctctgccattttctacagcttgctgagttgtcattcctttgcaacattaaaatacatgctgaactc

SEQ ID NO: 78646 - DNA, 247 bp, Homo sapiens
ccgagatcgtgccactgccctccagcctgggtgacagagcgagactccatctcaaaaaaataaaaaagtttgaccctctttatgtgccctgagactgagcagtgggtgtgttgccattctgtgtgtcatctgtttagttgctgtcgtttgatttgacagtcatgctgcaaagcttggagcccagctggccgatttacaccttgataacaagaagcttggaggggaaaagacctggggtaactctaga

SEQ ID NO: 78647 - DNA, 625 bp, Homo sapiens
gattgggaagtcaggactggtctcgacctgcacagtgaagtgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtgggtatggcactgcgcgggccacgggtgctcccgcctagaggaggacgttcagccggtgtgggctcagagcgggggccgtgcagcagccgtgggagggtcggacgtgggctgatggcagagcaagggaatgtcggccttgagccgcatctcacggtgcactgaacacagtgactgtgatgcgtctgttgtgtcctaaatgcatttgaaagatgaaaacatttgctggacacaagacacccctagtgttaca

SEQ ID NO: 78648 - DNA, 424 bp, Homo sapiens
ggatccccttacaaccccacgatcacctttccaagatacaggtcttccccaccccgagatggagtcttgctctgtcacccaggctggagtatagtggtgcgatctcagctcactgcaacctctgcctcctgggttcaaggattctcctgtctcagcctcccgatgtagctgggattacaggtgtgtgccaccacacctggctaatttttgtatttctagtagagatgggattttgccatcttggccaggctggtcttgaactcctggcctcaagcgaatctgcctgccttggcctcccaaagtgctgggattacaggcctgacccaccatccctgacccaactattgtttcttaaaaaaaactctttttaaccttgccttttgagcatgcctgtgttgggttgacagtgagggtgtcgtgggta

SEQ ID NO: 78649 - DNA, 1884 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataatgtaaaaagaaaaaatatttccctcatttattgtaattcaatatcttagttgtttgctgaaaaacttgtaatattttgtg

SEQ ID NO: 78650 - DNA, 2166 bp, Homo sapiens
cggcatctcaagatgaggtggtttccagtgctgggcaggaggtggcatggaacttggtggtctcttcaggtgaaaagtgaccccaggtcactggcataggcagccagggtgccgcctgcacctgagaggtcgggtgagtctgtgtcctgtaggtggaacaggactgcagttgaggtgtcgtctgaggacactgacaggtaacccatgttcacagtcccactgttgccggatcttagtggaatattagtgccttcgattttcctctctccagagaacctcccaattcaaccacagcacacaagtgtagtccaacactggaaagctcaagccctcttcttccagtacagcctctgaacctgtagcctaccctgttggcaagtgtgtttgaaaacactgtccatgtgtatggaatcctcagtcaggatagtcttggtttgaagttgtaatgctagaggaaaacatatctacagaaccttccggaagtaaccttgcctccctgtatttccacttcctctcgtatttttctgacaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataatgta

SEQ ID NO: 78651 - DNA, 1889 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggagcataacgcgctgtcaggatcgagggaattttccggtattttaatctgctgacatttggaatccgtgtgcagcccacatgggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataatgta

SEQ ID NO: 78652 - DNA, 1642 bp, Homo sapiens
ccgagatcgtgccactgccctccagcctgggtgacagagcgagactccatctcaaaaaaataaaaaagtttgaccctctttatgtgccctgagactgagcagtgggtgtgttgccattctgtgtgtcatctgtttagttgctgtcgtttgatttgacagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataatgta

SEQ ID NO: 78653 - DNA, 1345 bp, Homo sapiens
catactgctgcaggtgtcccaggtactggtctcgctgctgctgcagactttgagcctcttggctcttcagctccaccgtttccttcagctcgctcagcttctcctgcagctcgcccagcttctttcccagctccctcttgacgtgctgctccgactgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataatgta

SEQ ID NO: 78654 - DNA, 2004 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaaggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtccatcccgacggcgcgtgtgccgcttggctcaaggccctgacatcgttccactcagcacagcatcaggtgcccgggaccctggacatcatcgttctgtgtcagcacatcaggtgcccggggcccggacatcatcgttccactcagcacagcatcaggtgcctgggaccctggacatcatcgttccactcagcacagcatcaggtgcctgggaccctggacatcatcgttctgctcagcacagcatcaggtgcccgggaccctggacgtcattctgcatcagcacaacatcaccagtgacgagagcctccccaagtggttgacgggaaggatggttcggtcctccagaggcggtggccttctcttcctcgatgacattgccgggctgcaccttgtgagaggccgtcgctgagagtgcagccaaatggaaccatcaggaggggtgtctcgggggtgtcgaaatggtaaacagtagtgggtagttttcagattttgcaatgctgcggtatgtgtcagcttttaattttttattttcttttttatttaattttaatttttcttagacagtctcactctgtcacccaggctggagtgcagtgacatgatctcggctcactgcagtctccgcctcccaggttcaagggattctcctgcctcagactccccagtagctgagattacaggcacctgccaccatacctggctaatttttatatttttagtagaaatggggtttcaccatgttgatcaggctggtctcgaactcctgacctcaagtgatccgcccacctcggcctcccaaagttctgggattacaggtgtgagccgccgcgtctggccccgtgtcagcattttaaatttgtaagttgatgcaatgcttattctaaaa

SEQ ID NO: 78655 - DNA, 1628 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaaggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtccatcccgacggcgcgtgtgccgcttggctcaaggccctgacatcgttccactcagcacagcatcaggtgcccgggaccctggacatcatcgttctgtgtcagcacatcaggtgcccggggcccggacatcatcgttccactcagcacagcatcaggtgcctgggaccctggacatcatcgttccactcagcacagcatcaggtgcctgggaccctggacatcatcgttctgctcagcacagcatcaggtgcccgggaccctggacgtcattctgcatcagcacaacatcaccagtgacgagagcctccccaagtggttgacgggaaggatggttcggtcctccagaggcggtggccttctcttcctcgatgacattgccgggctgcaccttgtgagaggccgtcgctgagagtgcagccaaatggaaaacaatgggttcgaatgtaaacagtactgttaccaccggcaccccgagacaccatcctgatgtcgagcggttgggaatatagt

SEQ ID NO: 78656 - DNA, 1713 bp, Homo sapiens
ggatccccttacaaccccacgatcacctttccaagatacaggtcttccccaccccgagatggagtcttgctctgtcacccaggctggagtatagtggtgcgatctcagctcactgcaacctctgcctcctgggttcaaggattctcctgtctcagcctcccgatgtagctgggattacaggtgtgtgccaccacacctggctaatttttgtatttctagtagagatgggattttgccatcttggccaggctggtcttgaactcctggcctcaagcgaatctgcctgccttggcctcccaaagtgctgggattacaggcctgacccaccatccctgacccaactattgtttcttaaaaaaaactctttttaaccttgcctttttgttagggtagaaggatagctcagagcttcaaagagcaggactagcctaagaactgtctgtgatatttgaccagaggtgcagcctagctgccattcttcctcaccctgtggaagacattaaagggagaatgaaagtagctgtagaattacctttgggggaagaagccacttggtgaacttggcaaacacccgtgtttgaggggtcaagacctgggatgtcatgagctgggccggaggggatggattgattacttgtcttgtttgcttgtttctgttgtaagtcagggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtccatcccgacggcgcgtgtgccgcttggctcaaggccctgacatcgttccactcagcacagcatcaggtgcccgggaccctggacatcatcgttctgtgtcagcacatcaggtgcccggggcccggacatcatcgttccactcagcacagcatcaggtgcctgggaccctggacatcatcgttccactcagcacagcatcaggtgcctgggaccctggacatcatcgttctgctcagcacagcatcaggtgcccgggaccctggacgtcattctgcatcagcacaacatcaccagtgacgagagcctccccaagtggttgacgggaaggatggttcggtcctccagaggcggtggccttctcttcctcgatgacattgccgggctgcaccttgtgagaggccgtcgctgagagtgcagccaaatggaaccatcaggaggggtgtctcgggggtgtcgaaatggtaaacagtagtgggtagttttcagattttgcaatgctgcggtatgtgtcagcttttaattttttattttcttttttatttaattttaatttttcttagacagtctcactctgtcacccaggctggagtgcagtgacatgatctcggctcactgcagtctccgcctcccaggttcaagggattctcctgcctcagactccccagtagctgagattacaggcacctgccaccatacctggctaatttttatatttttagtagaaatggggtttcaccatgttgatcaggctggtctcgaactcctgacctcaagtgatccgcccacctcggcctcccaaagttctgggattacaggtgtgagccgccgcgtctggccccgtgtcagcattttaaatttgtaagttgatgcaatgcttattctaaaa

SEQ ID NO: 78657 - DNA, 1652 bp, Homo sapiens
tttcccaagttgtatagtgtaatcggcagctggtcagctgacatgatgtcaataacgacagcataacagatgaacacagatgcacacaccactgtcagtctcagcacataagaggtcaacttttttttttgagatggagtctcgctctgtcacccaggctggagtgcagtggtgcgatcttggctcactgcaagttccgcctcccaggttcacgccattcttctgcctcagcctcctgagtagctgggattacaggcctgacccaccatccctgacccaactattgtttcttaaaaaaaactctttttaaccttgcctttttgttagggtagaaggatagctcagagcttcaaagagcaggactagcctaagaactgtctgtgatatttgaccagaggtgcagcctagctgccattcttcctcaccctgtggaagacattaaagggagaatgaaagtagctgtagaattacctttgggggaagaagccacttggtgaacttggcaaacacccgtgtttgaggggtcaagacctgggatgtcatgagctgggccggaggggatggattgattacttgtcttgtttgcttgtttctgttgtaagtcagggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtccatcccgacggcgcgtgtgccgcttggctcaaggccctgacatcgttccactcagcacagcatcaggtgcccgggaccctggacatcatcgttctgtgtcagcacatcaggtgcccggggcccggacatcatcgttccactcagcacagcatcaggtgcctgggaccctggacatcatcgttccactcagcacagcatcaggtgcctgggaccctggacatcatcgttctgctcagcacagcatcaggtgcccgggaccctggacgtcattctgcatcagcacaacatcaccagtgacgagagcctccccaagtggttgacgggaaggatggttcggtcctccagaggcggtggccttctcttcctcgatgacattgccgggctgcaccttgtgagaggccgtcgctgagagtgcagccaaatggaaccatcaggaggggtgtctcgggggtgtcgaaatggtaaacagtagtgggtagttttcagattttgcaatgctgcggtatgtgtcagcttttaattttttattttcttttttatttaattttaatttttcttagacagtctcactctgtcacccaggctggagtgcagtgacatgatctcggctcactgcagtctccgcctcccaggttcaagggattctcctgcctcagactccccagtagctgagattacaggcacctgccaccatacctggctaatttttatatttttagtagaaatggggtttcaccatgttgatcaggctggtctcgaactcctgacctcaagtgatccgcccacctcggcctcccaaagttctgggattacaggtgtgagccgccgcgtctggccccgtgtcagcattttaaatttgtaagttgatgcaatgcttattctaaaa

SEQ ID NO: 78658 - DNA, 905 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagtttcgtttaatagtgaatattaatgtctctcttgtttctagtatcttttatcttcctgtgatcattttttttttatgtggagtattc

SEQ ID NO: 78659 - DNA, 1808 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtggggagaggaggtgggcaggaggaacggccctttgtggcccggtttggatttgacgtggtgacgtgctgtggatacctcccccaggtgaatgactggcaggaggactgggtcgtgttctatgcccggcagcgcattcagccccagatggacatggtggagaaggagtctggggacagggaggccctccagctttggtctgctctgcagttaaagatccctgacctgttccgtgacctggagatcatcccagccttactccacggggacctctggggtggaaacgtagcagaggattcctctgggccggtgatttttgacccagcttctttctacggccactcggaatatgagctggcaatagctggcatgtttgggggctttagcagctccttttactccgcctaccacggcaaaatccccaaggccccaggattcgagaagcgccttcagttgtatcagctctttcactacttgaaccactggaatcattttggatcggggtacagaggatcctccctgaacatcatgaggaatctggtcaagtgagcgggccttactctggaaggaggcctcagaggtttctccacagtcctcttctgggcaaattcttgtttcttcacatgccggactagcttaagaccaatgcagtagcttatttccaagccttgcaaagtatataatatctaagaggaaaggttttgtcatcccagcgttgtccactttgtggggctttgtaggtagacggagccacactacaggcagggtatgagcagagggatgtatggagtgtgggtgactctgagcctcactgctgctgcaaggtggggaaactgtaagtgaacccctgtgggtgcgggggagggtatccggtgcgcagggaggtggccagcgcccccgggcactgctgctcataggtacctttccgctgcctcctccctgctctcctgtgcaggaatgtctctgagctgttcacgttgatgcttcttggttggcaagacttgggtgtagacatgaaaccatcttactaaaagcgtcttaaaatgaccaattccagaatcaagcgtattccgttttcttcctgcatgatccctgggccctcccgcaggctgagcaagtctgtaaactgattctgggagaaaccaagctgctggccgtagggtgtccttgggtacatccaggagtcttcattgcttctgttattaccccgtctcctctgccattttctacagcttgctgagttgtcattcctttgcaacattaaaatacatgctgaactcatatttttccttccttcactgttgtagtaaagagacatatttcatgaatggcattgatgctaataaatcctttgcacaaaaatttgaataaacttccagtggtttcgataatgta

SEQ ID NO: 78660 - DNA, 1247 bp, Homo sapiens
ggtaggtccatcccgacagcacctgtgctgctcgactccccccactgggtgggtccatcccgacagcacctgtgccgctcgactccccccactgggtaggtccatcctgacagcacctgtgctgctcgactccccccactgggtaggtccatcccgacagcacctgtgctgctcagactacccgccgggtaggtccatcccgacagcacctgtgcccctcacctccctgccagacggtgcgtgtgccgcttggctccccaccaggtaggtccatcccgacagcacctgtgccgctcacctccccaccgggtaggtccatcccgacaacacctgtgccgctcacctccctgccgggtaggtccatcccgacggcgcgtgtgccgcttggctcaaggccctgacatcgttccactcagcacagcatcaggtgcccgggaccctggacatcatcgttctgtgtcagcacatcaggtgcccggggcccggacatcatcgttccactcagcacagcatcaggtgcctgggaccctggacatcatcgttccactcagcacagcatcaggtgcctgggaccctggacatcatcgttctgctcagcacagcatcaggtgcccgggaccctggacgtcattctgcatcagcacaacatcaccagtgacgagagcctccccaagtggttgacgggaaggatggttcggtcctccagaggcggtggccttctcttcctcgatgacattgccgggctgcaccttgtgagaggccgtcgctgagagtgcagccaaatggaaccatcaggaggggtgtctcgggggtgtcgaaatggtaaacagtagtgggtagttttcagattttgcaatgctgcggtatgtgtcagcttttaattttttattttcttttttatttaattttaatttttcttagacagtctcactctgtcacccaggctggagtgcagtgacatgatctcggctcactgcagtctccgcctcccaggttcaagggattctcctgcctcagactccccagtagctgagattacaggcacctgccaccatacctggctaatttttatatttttagtagaaatggggtttcaccatgttgatcaggctggtctcgaactcctgacctcaagtgatccgcccacctcggcctcccaaagttctgggattacaggtgtgagccgccgcgtctggccccgtgtcagcattttaaatttgtaagttgatgcaatgcttattctaaaa

SEQ ID NO: 78661 - DNA, 611 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcgcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtgggtatggcactgcgcgggccacgggtgctcccgcctagaggaggacgttcagccggtgtgggctcagagcgggggccgtgcagcagccgtgggagggtcggacgtgggctgatggcagagcaagggaatgtcggccttgagccgcatctcacggtgcactgaacacagtgactgtgatgcgtctgttgtgtcctaaatgcatttgaaagatgaaaacatttgctggacacaagacacccctagtgttaca

SEQ ID NO: 78662 - DNA, 666 bp, Homo sapiens
atccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggccagaagaatgtttgaaggtgagatggcaagtttaactgccatcctgaaaacaaacacggtgaaagtgcccaagcccatcaaggttctggatgccccaggcggcgggagcgtgctggtgatggagcacatggacatgaggcatctgagcagtcatgctgcaaagcttggagcccagctggccgatttacaccttgataacaagaagcttggagagatgcgcctgaaggaggcgggcacagtgggtatggcactgcgcgggccacgggtgctcccgcctagaggaggacgttcagccggtgtgggctcagagcgggggccgtgcagcagccgtgggagggtcggacgtgggctgatggcagagcaagggaatgtcggccttgagccgcatctcacggtgcactgaacacagtgactgtgatgcgtctgttgtgtcctaaatgcatttgaaagatgaaaacatttgctggacacaagacacccctagtgttaca

SEQ ID NO: 78663 - DNA, 371 bp, Homo sapiens
tttgggaaataaactcctttgtggagccagttgttctattggatgaagtcaatgtccctttttaggaacttgagctaccactttatgtactctaagacacagtttgcaaaggaccagtctgccataccccatgcaggaggaggactgtgttggctcccaccacagggtgtgttctgtggtaatggaaggctgtgctgagtcacttacactgtgtccctgggtcttccttaaggacagtgtatggttttagaagataatagtagcaaacatttatctaccacctctctagatcagctaggcattcttttttttttttttttgacatagagtctcactctgccggccaggctcgagtgcagtggcatgatgaa

SEQ ID NO: 78664 - DNA, 566 bp, Homo sapiens
aagggccagatctagaagtgatttttgtctaaattccacaaagactgactttttttgctcttttaggacttgtatatcttctataggttcttaagcataattattaatgggcatttgtgtgtttttggggtaaatatgaactattaaattatttgattacctgccagaactcgtagtgccacattttgccaaattaccaacctcaaaaaaaaaaatggaaataatttttattgaggtgaactctataataccctgtttaactttatagaagttgccttggagtttaaatgttccattttctccctgattaaaaaaggaagagatagaaaagttagaggtttttatttttttagtttgatgtttcatattagactacagtgtgatatattatagtttctataagcagtagaaactataaagatagatataaactgtccagaattaagtactgagagaaaaatattaaaagcaaaattaatagaaccttgatattgtgggacaatatcaagcagtttaacatacctgtaactagagttccagaaggaaaggagttaggtacaggccag

SEQ ID NO: 78665 - DNA, 361 bp, Homo sapiens
cagcttctccacttccaaaaaataaatatgaaaactataacacttgcccaaggtctaaaagaaaccaggaagcgggcaggttaagggctaacaggtaacttttctctgcttctgtctgttgaatgttaaggaactgttcgtttcatagccgagcattttaagggtgctatgctagaggcagctctgtgattttcattctttggctacaacccctggggaggtgaggtcatgaggaaattccaagggggtcaaggagaccagaaacctagctggtcacataactgctcagtggcactgccggagaccagccccagcccccgtgccaacccccatgacgccctattttcagagccttgctgat

SEQ ID NO: 78666 - DNA, 385 bp, Homo sapiens
atgtaatcatgtgaagtcatacgttttcctctaggatagttgtgtttagattataccaaaacagctcttagttgaagtgattcaagtgtttcttttttccctatctgccatcaattggccaagtttttgatactagacaagaattcaatatattaattaaaaagtcatttcagacttggcttaactgaaaagcagaagagaaaaatcctttagagaatggattggcatactttatttctagagtcgatttagataaatactttggaatccgatgtgagtaaatgatatgtttcacatttcttctcacttgccaaacagttatttgagaataaactctggcttagctttaagaaacttcttggacattgaggattgagattaattg

SEQ ID NO: 78667 - DNA, 422 bp, Homo sapiens
gctgtcgcctactactactaaattcgcggccggtcgacgataatgatagtatttcagtatgtttccaatatgtagagataaaagaaaaaagaacagcagatgtgttatataaatagaactatgattagttaagattcattacaaactccgaatctctgattcgtgtctccatactcatggagtcatttcacctttgtagtcagtattattctctctgatgagatcttctcttcagaaaataatgttaatttcttatcgtttcttcttttaataagaaacaacaagcttttatatcttaaaataattaccaaatttaggtgtatgaatttttcaaccagcaaaattattttaaaaatgtaactatataaaattatgcttatgttcatttcaaaataaaaccaattatttccctattaaggtaa

SEQ ID NO: 78668 - DNA, 309 bp, Homo sapiens
gttttcactaaaccataactatcttctttggccacctagataattaattctgacattcacatttaatgtagcgtaggttaccaagttcctgtgtagaaagggagctcacttttttagagaattaagtgctatcactataaagacaatgctgcacctaaggtgtttgttattgccctaactactgttcctgagttgtgtggactataagcgagctgtttagtgagttcactttgatctatcctactgctaagaccggaaaaggaagtggaaactgagatttgaaattaagtcatgagataaatctgtgtt

SEQ ID NO: 78669 - DNA, 732 bp, Homo sapiens
cttcccaaaggtggaagcaagaagcaagttttctcaggtatttgccacaggagcctggtggagctccaggaggtttgatctctcttgtgaactctggaactgtattcccaattgtcaattggacatccctacgtatgggacctcagatatttcaaacatgatgtgtccaagtctgtatcacttctggccatcatattgttcttttatttttccaaatttcacatcaccagtaacaaactagctgtgatcatggcagatagcctggaaataaaactcccctttttaccctttgcacagcaaattgacatcaaatcctgtttctactttttttttttttaactattgcttccctattctgtattctcactgctccatctcctgatgtaggaggtcatctgttttcctcttttcctctcctctgactcttaagccctttcccattctctttctcaggaatggctgttaaaatgccaatatggtcttgtaactttcctgtacttagtgaacctccttatttacaccctgtttgtgaagtggctgtgttcaccctgggtggacacggaatgtttttgtcatgtacaaagagaattttatgctgcctgtgtacagttattaatttgtaagtacactcagctttttgtatctgtaggtttaatatctgtgtatgtaagcaaacttggatgcaaaatatttgaaataaaatcagatgcttgcatctgtagtgaacatatt

SEQ ID NO: 78670 - DNA, 228 bp, Homo sapiens
tccaatagatgtagaaaattattaaaatttaatatcgtgattaaaaacaagtcttaacatactctaagtagaagataatttatttaacctaaccaagtatgtctaataaaaacctgcagcaatcatacttgatagtgtaacattgaaagcctttcatttaaaattagtaaaagatgtctgctctcactacttccattcaatactgtatcatggctctacccattgcat

SEQ ID NO: 78671 - DNA, 340 bp, Homo sapiens
ttcctttgcatatgcagcactgaccaatggaaatataagaagaaatctctaaccttacagactcctcaattaaagaaatcgatgcaggaggaaaggccttgtacttcctggtttggatactgtccagtgaaggcgtgatgtctagagccaccacaactattttgcagccatgacatgacaagtctaaaaacaaaaagcaacaggctatggacggcagagctgaagaacaaaaagatgctggcttcttgatgacaaggttgagccataaaccaatcccaacacacctactccagacttcttgttattgaagagaataaaggtatttgataattaaactact

SEQ ID NO: 78672 - DNA, 381 bp, Homo sapiens
aaaggacagaataacaaatcaatatgagttaatggaaaatttcctatagcataaactcaatggagccactaactgtatactggtgggaagtagctcagttaatatacacaggccttattctctctatccctgaaaaaaggggggattggattatattattgtacattttttcagctttgagaattgaagaatttagataattttccttttgtagattgaagcaatagcttaaattcagtaagatgaaatatagtaggaacaaatagaaccatatttgtctttaaaattttaaattatatgtcagaagaaagagtctagaaatccttgaaaatctctaggaagttgcaactaattttaggtttcagaaaaataacatgatca

SEQ ID NO: 78673 - DNA, 833 bp, Homo sapiens
tgcaccatccctcccttctcccccacccctgaccgtttaaaacaaaatgtctcaaccagtcagtgatactcacttggagaaggaaatgtttctttaggatgttaggttgacccatgagaacatggacaatttttggtcacttaagcaagttgccacaattaagggatggactggtttcccagttctctgtttgcatgattttgttggactggtggaagaaatggcctcgtgtctcctcgtatgttgtctggagagttcagagatggaaaatcttgagacagcaagaaaagcatgattgtagaatcagcatccctgattacattagacctggcaaatggacgcctggatcccagggagtcaggctatgtcattagatggaagatgcccttgagatgcaggctgagggccctgatgattgcactgcggggctaatgcacatagagatctgggtcatgaggagtggcactcactgcggcatccgctttgtgacactacatgttctcagttcctctgtctctgaccatgccaggctcacttgtcagttcctcttctttcctctaataagccctttgttacatttatttctttacatttctccttggagatccactgcagtggcttctaacctgttgcacgcgtcagaatcaccaaggaacgcctgggaaaaaaatctggatgcttgagcgtgacccaggaggttctatctcagcaggttctggaatgaggcctgggattcagacatcgttgaaactccacctttgatcctacccctagtttgtatctgagtgtccttcctgccccagcccacagccccatggctggtgtgttgaagg

SEQ ID NO: 78674 - DNA, 434 bp, Homo sapiens
actgaatacttaggcaatttgaacacaaaggtaagtaattgtgtatctaaacatttcttaacatagaaaaggtacaattcaaatacaatattataaccttatgctaccactatcatattatgtggcctgttattgacagatacattgttattctgttcatgactgtattagtaccaggttgtggctgtttctaatatatcctctcccactcctctcattccttactgaagtcaccagggtagtagcaaatcactggaaccagacctataatatatctgacttggtatctgtaactgttctgagaaacatgtgttgaaaggcagccaggctgcctgatgattatttagtagctgtctttctttactgaacaacagtgaataatatctttgatctctgccactgagaaataaacagaacccatcaggaatttaatc

SEQ ID NO: 78675 - DNA, 841 bp, Homo sapiens
gttcccaatactatgtagaccctgggaatacacaggctgagctggtgaggagtctgcctgcctggagtttagagaagttcaaggacagttaagttgacaatggactagagctactttgcgtaagaggtgcgctgaaggcaggattttgtcctgccctcaattccaggagatatttggtaaagtctggagacatttttaatgtcacagttggatcggaggcgctcttgtatctagtgggtagaggccagggatgccactaaacaccctcaaatgcacaggtcagctcccacgaaaaacaatgattcagtcccaaatgtcaaaagcactgcatttcggaaaaccgtcctagtggtagagaaagaagatgggagaaggactttttgcaggaaaattctcttactgtaatgtttcttactccaacacaaaacacatacacacacatatatacatgcacacccacacagataaaacagacaaatcagtgcattgctttgtgggcctcacatcagcctctgaggagacttgcatctctcagtggtgggggacacattcagggtttctagacgtgtcccaaaccactcactttccctgaattttcagcatttaggagaaatttccatggagaagaagaatcgctgtctggtcatccatgcaatttcctgctcagttttaatagcagctgggcttctccctgtctaaggttgaaaccaaaaggctgtattttcctgtgggggcgagagagagagagagagagagcgagagagagcaagagtgagagagcgcttacaaacgcctccctggacatttagaatttctaaatagaattttggctcaagtcttg

SEQ ID NO: 78676 - DNA, 482 bp, Homo sapiens
atagattcatatttgaccataattatttatttcaacatttctctgcactaccagactttgagttccctggaactaaaaatattgcttggacctcacgctgtacctgaatacctgagagggaacaaattctaccagttgctgttggaagcaaaagatctttttcattcttggatgctttatatttggacagagaaagaatcagaatccatccttctttttcctaaccggaatttgagagacatgagaagggaactaaacacacaggcttcaggatctggtggaaagagataaggtgtctcaacgactgttggcctcatcaagagatactacccctgatcttttcatttcactttcctcgggtctgcctaaactcagtgtctctcctagaaaaccacccaactcatgaaaaactgtttgtaagaaaatgttctcaacacaaagaaataataaaggtttgagatgataaatatgctaattaccct

SEQ ID NO: 78677 - DNA, 569 bp, Homo sapiens
aaatgagtaacatcagggtataaaatgccagctggaagagtattcgcaaccatatacaatgaagagtcacacttccaagaagaaagccgatgtcccacttcagcatcaaatctaagacactgcatttcactttttctgtacaaatatcataatctgtttgttaatctcttggttttatttcaaaaatgaaactatatttagagagggaacaaattctaccagttgctgttggaagcaaaagatctttttcattcttggatgctttatatttggacagagaaagaatcagaatccatccttctttttcctaaccggaatttgagagacatgagaagggaactaaacacacaggcttcaggatctggtggaaagagataaggtgtctcaacgactgttggcctcatcaagagatactacccctgatcttttcatttcactttcctcgggtctgcctaaactcagtgtctctcctagaaaaccacccaactcatgaaaaactgtttgtaagaaaatgttctcaacacaaagaaataataaaggtttgagatgataaatatgctaattaccct

SEQ ID NO: 78678 - DNA, 501 bp, Homo sapiens
tgcaagccaccaatgccaggctaatttctttgtatttttgtagagatggggtttcgccatgccgcccaggctgatcttgaactcctgggctcaaagggaccctcctaccttgccctcccaaagtgctgggattataggcctgagtcaccactctgagccactttttaatacatacagtttgaagtgtctgaacgttgaagcggaggatttgagaaggtcgttgggtatctagttctcaggcttagtagagaagcttgacctggagataagagcatttcctctgagtatttgaaaaattgtgttaggcaatatcattcactaaaaagggcttctgggtgaaataaaagttaggaacagactctcaaaaacctgtgcaactttataagcagagcatcaagaaaagtaataattttcaaaaacagcatttgggagaccaaggcaggcagatcacctgaggtcaggagttcgaaaccagcctggccaacatggcgaaacctgtct

SEQ ID NO: 78679 - DNA, 192 bp, Homo sapiens
ttttgtatttttaggagagatggggtttcaccatgttggctaggctggtatccaactcttgacctcaggtgatcctcctaaaggctgggattacaggcgtgagccaccatgcctggctggtcttggtatttttctatagctaaaataagacaaattttaaatctggcattgaaactcaaattagccttattt

SEQ ID NO: 78680 - DNA, 231 bp, Homo sapiens
acacccagttaaagatcatgtctgaatgtttttacaacctccttgctattgtgtgcttaattactgtaaagcagactttacacaggattccagaaaaactaattcagctgggcaaacaacagagctagttgccgttttgttcttctgttgcatttcaattatctgaatttgtaaaataaagttcataaatatttaagaaatgcttttttgagctgccactcttaaaaggca

SEQ ID NO: 78681 - DNA, 560 bp, Homo sapiens
gcatctaggccttgattttgagttcttagtatggtaccgtgaaaatcactagtgttgaaaggaataggatcagagggggaataaaaaggcatttgatgaggctcttagtgtaacagtatgtctcactcatctttttttttccttagcctttgaaatagacaatggccttgagccttctcggcagatggaccatgtttgtgccttagccacttaacagccattagcctaattccatcctctacagccaaattaaataataagtaaaggcctatgaaaagctggtttggaggcagtgttactgcctttcacttgacagccttctctgaagcagatgctccctctccaccctattaacctgctcctctgaataaggagctgtccacacagaagcaaagatagaggcctgcaggagagtggtctggattctggagatagggggaaaatcctgatgatgaaagtccagcttctttggaaggctgaggcgggaggatcatgaggtcaggagttcaagaccagcctgaccaatatggtgaaaccccgtttctactaaaaatacaaaa

SEQ ID NO: 78682 - DNA, 364 bp, Homo sapiens
tcaggctgtgccttataccctttaggatggaatagcccggagataatgcaaacatgtgggaatgtctccaatcaatttcagttaggtacctgtcggcttggctgggcctattactgtgctggaggtggagcagctgcagccatgttgatctgcacctggctctcttgctttgctggaagaaaccccaagcctgtcatattggtggagagcatcatgaggaataccaattcttatgctatggagcttgaccattgcctcaaaccttgagctttgaaagaagattggagagggtgggaaaggggaggagggagccctgaaaagaggtactaaggattaggccatttgtcatctgactgtcattagc

SEQ ID NO: 78683 - DNA, 12756 bp, Homo sapiens
  misc_feature (7731)..(7731): n is a, c, g, or t
  misc_feature (8088)..(8088): n is a, c, g, or t
atgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagcnggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacantcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcactggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggtgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcatcgtaatgggtgt

SEQ ID NO: 78684 - DNA, 12812 bp, Homo sapiens
  misc_feature (7731)..(7731): n is a, c, g, or t
  misc_feature (8088)..(8088): n is a, c, g, or t
atgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagcnggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacantcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcactggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcatcgtaatgggtgt

SEQ ID NO: 78685 - DNA, 10990 bp, Homo sapiens
  misc_feature (7731)..(7731): n is a, c, g, or t
  misc_feature (8088)..(8088): n is a, c, g, or t
atgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagcnggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacantcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcactggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagc

SEQ ID NO: 78686 - DNA, 704 bp, Homo sapiens
aactgctctcagagaagcttccagtggaaccaaaggaatacagatggagggcctggggagagatggcctgaggggacctgcagaagggatttacctgctgcccctcccccaggggagccaggagactgagctgggctgtaaacactccgtgcctggtgcagcctggtctgcacaggctgagaggatgctctacttctaaaccccataaggaaaaggcccaggagggacggggatgttgctgctgatagctaaaaatgatcaaattcttaccatatgccagaccttatgctggacaattcactgacattatcccacgtagtaggcagaattctaacgtgacccccaagattctccaccttctgtgtaatccccaggattgtgaatgtgatggatttcattctggtaaacaggttttgttatatggcacagatgactttaagacagggaggctttaaatctgtgactagcagaagacatatggaaggcagagattcaaaatataagagggatctgacgcaccactactggcttgaaaatggaggggaccacatggcagaggacgcacgcagcctctagttgctgagggtggtctccagttgacagcggcaaggtaacaggggcctcagtcctacaaccacaaggaactgaactctgccaacatactgaaagagcttgaaggaggagcataagcctcaggggtgaga

SEQ ID NO: 78687 - DNA, 335 bp, Homo sapiens
taaatctaacatttactaagtgattagcatatgttatgaaataactatacaggaggtttaatccttatccccatttttatagatagaaaaactgaggcacagaaagttaagtgagtttcccagtgccatacaggaactaagtgactcaaatttttccaaaatagtggcaagggtcccagaaagactgattctccagttctaggaatattgaacttgggttttctttctgtgttgtcaatcctgaacaacatgcatgttgtatccttcttctcagcattctttgctcatttgcatagattcaattttttaacgttttttttttctttctgttgaag

SEQ ID NO: 78688 - DNA, 743 bp, Homo sapiens
ccagatgcgggaaagaactacccacttcaggtctctttgactcaccaggactaccagcagcaggagggagctacccatgtcgggtctccttgactcatcaggacaacctgcctatggaaaggagctatccactgtcagtctcctctgctgagagctggacactcgggatgacatgcctgcggtacccactttgggtctcctgagagctgtcgctcaatgaagcttctctccaccttactcactctccagttgtctgtgtacgtcattcttcctggatgcaggacaagaacatgggacctgctgaatggcgtgactgaaaaggctgtaacacaaacagggctgaaactttgccctcaaccccctggcccaacacactgtgggcaatgagaaggagagaagagctgctgcccttcaagggacctcagacctaggggctccccaagacagggctgtgacatcctctttgtggctctgtcgttcctggcatctccaagcttctgggtgccactgcattcccctcatccagacgtggatgcccacagtggaagcctcgtgtagtacatctggttcagctgcagcctctgtcagcagctgtgcgggtgcctggaactgcccaccctgttgcagctggcacacctggctttgcacagtggctggaccctgagcttgtgcacacacccctcactgttctgtgcctggcttgccattgggaggcatgggatctgggccagcagcacaagcca

SEQ ID NO: 78689 - DNA, 416 bp, Homo sapiens
cctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatct

SEQ ID NO: 78690 - DNA, 380 bp, Homo sapiens
gcctactactactaaattcgcggcgctcgactcttgtttacaaaaaattttgtaccacaccatagcagtaggaaattattgaattgtaaacttttgcaactaacaaaactgtagacagcatttaaagttagctgaggcccctagagtaaattttgaaagatcatagtgagagtgtcagaattagaattcagatgtcctgctttctgtcttagtatgtattcattctaaagtgaatttactccataattctcctctcactgggaaaatgaaacattatcgttagtctctgtactttttattcacaatgcccaagtaaaacaaaaaacattataagattctcaagaaagaaagaaaaaaaagtcgacgcaaactcaaaaata

SEQ ID NO: 78691 - DNA, 324 bp, Homo sapiens
cctgggatgagaatgataggaggtgtagcggggttgagctggataatataaggttccttacagctctagacatttatgatttaacattttttatggattgctaatgctgcttttttttttgttttaaatgtcaaattcttgcatgtataaggccttgattctttcaggcctgggttgtgttgatttatgggcatgagctaattccagatgactcattctagaagtgattgtgtaagtatcctttacttagctaaacatatgcaacataaattcatctactataacatatgttctctcagaacatgctactggccagagttatta

SEQ ID NO: 78692 - DNA, 538 bp, Homo sapiens
agaggaagtatggtcacctgcgcttgcgggccagcaaagcagtggagaggaccttgggcgagtgcatgacagcaaagtgaggtggaggaaggctgtaagggagtggaggctgtaggtaggcaggtgcgcatccatggtggctggtcagcgggagctctctgacggtgaggcatggtctgctagtgaaggagctatgagaagggcccctgggaagcaccctggttaggcatgcgaggctgtgccacaagcgggcatgccatgctggggccccaggagaggctggcagatgaggacactcagatcggactggacatatctcatggacaagactgccctactctgtccaggtcctacagttacccaaaagctaaagccacctagaagagtatggcgagccttggaggatgggcatccctggccatcctgctccacctgtgtttcgaactattttgtctttcagcagattttttaacttaaatgtgtgacgttatttttttccagaaaatcatttatttctaagtttaaatctttttttcaa

SEQ ID NO: 78693 - DNA, 446 bp, Homo sapiens
agttcaagaccagcctgggcaacatagtgagactccgcctctacaaaaaaaatttaaaaattagccagatatggtggcatgtgcctgtagtcccagctacttgggatgctgaggtgggatgatcacttgagcccaggaggttgagattgcagtgagctgtgactgtgccactgcactccagcctgggcaacagagtgagaccctgtctcaacaaagaaagatgaaaagttatttgttggagtaattgtaaaggtccatgaatgtttaatcatggacagcttatactggataaagccagtttagtttttgtttcatagttcaaaaatactttaaggctcaaattgaaagcttttattggtcagttgatactaaaagtgcagtgttaagagaacttaaaaaccatgcacattttcagtttcataacaggttttctctttgtttttatt

SEQ ID NO: 78694 - DNA, 491 bp, Homo sapiens
atctccctgcttccgctggccccgccttactctgttgcaccgcccagtcgcccggctttccactgagggacgccccctgctctggactgcttagcctactccagctggccccacctcacctcatcggccccgcctcctccgctcgcccactccgggcgcccactcctgaggagctatcccagagtccgcgcggcctcgccttcccggcccgctcaccaccccgcctcgtcccacctcgcctcgccctccccgggctctagccacttggtgcggcaggtgtcctgcaggccggctcgagattcccgagctcgccctcgtggtgttccaggaacacggtactttgcgctagcctggcctgtcctgagagactgcgggaggcgaagagaacgcgctgttgctgtgggaagcgccggggacgggacagctacaccgccaaacacttcgctagggaaagggctggctggtttcgtgcgtaaacaaccgaaaagggg

SEQ ID NO: 78695 - DNA, 252 bp, Homo sapiens
atacaatatttctaagactcagtacaataaaaaaatgcaaaatacaaatgattttttatactgatgacatgtaatgatcatattttggatatattgggtttacaatatttttaaaattaatttcacctgtttctttttattgtttttaatgtggctactagaaaacttcaaattataatcatgtttggctgtcactgtatttctaccggttagtgccgctccatatcataaaaacagtaaagatatttatgg

SEQ ID NO: 78696 - DNA, 363 bp, Homo sapiens
ttttttggtggagtacccccaggacttttcactgatctcattccacccagctcaggcccctttccatttcataatagtttctctccatatcttcccagaaatcttggcttggtcattttcaggaataaggaaagctgagacatggaaaaagagtaaaattgtttgaatgagaatgaaatatctgctccaaaatcacctctaggtcaatttatacaggatatctcatctccatcctcattctgtttgccaagattttcaggattcataatcatggcactttaaaactactatttctgccattgccacatttgtactagtatggtgcacaaatgggtgatacctcataatggaaacattactggg

SEQ ID NO: 78697 - DNA, 834 bp, Homo sapiens
agggagggaaaaagaaaagcaaagaaaaattacatgaagattcccggaagtcagaggggcggaggctgaagggaggcagtgtgcacagtgcggatgccatgggcaccaaggattgtcatcatttacccatggggctctctcccccaagactcccacattcttaaatgtgtgtgttcaaggccagcccccaagctgggtacagctaaagagattcaccaggtaaagttcttgcccttggggaaggcagaaacgaatacacacaataccacgtgagcgagcaatgagagagttgcctcgttgtcgtgtgggagcccagagctgaggacactatcctctaccagggagtcagggaagacccaaggaagtgacagtggcctagaatcagaaagggtgagcttgggcagttccagtttctttggaaactgaagcttactcagtggtgtgcacgtgtgcgtgtgtgcacgtgcgctggcaagaggaagtagaagcctctctaaacaaaaggatacaaaaccaaaatcgagtacaaaatctaatattaatttagaatgagaaaagaaatcagaacaaattactttttttttttttttgagacagagtctcactctgtcgcccaggctggaatgcaatggtgtgatcttggctcactgcagcctccgcctctcgggttcaagcaattctcctgccccagcctctgaggagctgggattacaggtgctgaccaccatgcccaggtaatttttctgtatttttagtagacacatggtttcaccatgttggccaagctggcttcgaactcctgacttcaagtgatccgcctgcctcggcctccca

SEQ ID NO: 78698 - DNA, 1819 bp, Homo sapiens
ctctgcagtcacacaacctcacccagttacgaagagctagtcacctcaactgcattgtcccaagacaggcagagtaggtaaaaatagtcatatgttaaaattcaaggtttagataaaaagacaactagttcttgcttgctttgattaacttttattatgcagatgcatttgaactggagaagcttgtcatgtttctctctaaaagatgtttttaaatgttattgctcaaaatggaaaaaaaaaaaaagaatcagtaagtattcctgacatgtaggattgttgcctggctgatcacaatgaaaatgttagctatgactaatgaaggaattatcacaacttacattggtattaataataaacaaatataagccaaagctatatataaccaatttagtgctatgtattggtgaaaaaaacagaaagttacagaaattactcacaatgaaacatagaacaagttagaaagggccttttttttttttgaaataaaggacttttgtctgataagtagcagtcatttgacctcaaatcattaaatggggaaagtctaaacaagaaaaggtaatgtttacctgaatgttggggaaagcattaggatttatggcccagacttaaagattgtagaagattgtatataattacagcaataagcatttgtgtaagaagtagctattatgctgaagaaagatgggcacacaaaatctctaggcaaatccttggaacaggggaaagtgatactgctcatagaattattggttcgagaggcagcaaatatgatgcaataagtatatcaaactcaattaaaaatagaggacagaggtatgtggtgggggaaaacaaatgcaatagggctaagtcagcttacagggggtgaatataatttgaacatggcacccccaatttacttgatcataaagttagccaaagacatgagtggtcgatctttgacaatactctagtgatctccatgagagatggcctgatagatgttggatagaatgaagggccatttgatgaacaagttttgtagatttacatgtgacttggcactgtgctgacattagagccttctaagaatcagataaattaattaggtgaaacattttttcccaaagcacttgcatttcagaaagtttctcatttctgactcagcttagaacccatcccttgttacaggtcatttctcctccttataagccatgtctgtttcttttttccatcatgtcatacaccctatccacaaaagatggtagctcacgttttctaactagagacgtgcaggcaagttgagagcatgaagaatcccttgggaataccaattctgtagcaaatgctaaggtaaaagaaaaactatgcattatttttcaactatagttggcttaaattcttagtttcaccctggagaccatgttgccagtggacaattgagcatgctgtgatttataaaatgcaagctagtttatatgataatgtttgccatctcactttaccagtactgttgaccttttcatatgattctaaaatcacttacttgtaaataaatactcctagttctgtagatgaaacaatttggaaaagtcgttactgtttactcactgacattttattttagcacccattataatcagtcacacatcgcatctgtgtttgtgatgcttatcaactgttaattttcacagttttcatgctaatttggatccataaaatgatacagtttgttcacaacttccatagctcatgtaatgtaattcaaaacgtttccacgtgcagactaacatttcccataacaaaacaaacttttctaccatagggataagag

SEQ ID NO: 78699 - DNA, 332 bp, Homo sapiens
ggcatatttaacatggtgccaggatccagaaaccagggaggggagacacttggaggatgctcgatgtcttctcctccactctgggtcatacagaaaggaaggagactaagaggaagcttctattctcacttctatcctgcctcagcctccagagtagctgggactaaaggcgcccaccaccatgcctggctaatttttgtatttttggtagagacggggtttcaccatgttggccaggatggtctcgacctcctgacctcgtgatccgcccgcctcagcctcccaaagtgctgggatcacaggtgtgagccaccacgcctgacccaaaattt

SEQ ID NO: 78700 - DNA, 1009 bp, Homo sapiens
gctaggctcctttggttagagaagccagtccttcagcctccaattggtgtcagtacttaggaagaccacagctagatggacaaacagcattgggaggccttagccctgctcctctcgattccatcctgtagagaacaggagtcaggagccgctggcaggagacagcatgtcacccaggactctgccggtgcagaatatgaacaacgccatgttcttgcagaaaacgcttagcctgagtttcataggaggtaattaccagacaactgcagaatgtagaacactgagcaggacaactgacctgtctccttcacatagtccatatcaccacaaatcacacaacaaaaaggagaagagatattttgggttcaaaaaaagtaaaaagataatatagctgcatttctttagttattttgaaccccaaatatttcctcatctttttgttgttgtcattgatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaaccttagcccatctgcgggcagagaaggtctagtttgtccatcagcattatcatgatatcaggactgggtacttgggttaaggaggggtctaggagatctgtcccttttagagacaccttacttataatgaagtatttgggagggtggttttcaaaattagaaatgtcctgtattccgatgatcatcctgtaaacattttatcatttattaatcatccctgcctgtgtctattattatattcatatctctacgctggaaactttctgcctcaatgtttactgtgcctttgtttttgctagtgtgtgttgttgaaaaaaaaaacattctctgcctgagttttaatttttgtccaaagttattttaatctatacaattaaaagcttttgcctatcactctggactgttg

SEQ ID NO: 78701 - DNA, 4752 bp, Homo sapiens
  misc_feature (789)..(789): n is a, c, g, or t
taggattaaagaaagtgcagtaaagagaaagcatgaagacaccatcacaaacagattcccacaactccatgctgtgtgctgcaggctggtcctgaacccagatctctggctgagaggatgggggcagatggggaaacagtggttctgaagaacatgctcattggcgtcaacctgatccttctgggctccatgatcaagccttcagagtgtcagctggaggtcaccacagaaagggtccagagacagtcagtggaggaggagggaggcattgccaactacaacacgtccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgantacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacaccgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgacggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaggaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 78702 - DNA, 878 bp, Homo sapiens
ttaatttcttggtttcttcccagaattatattttaatgactccataaatacattccaaatattcagagattcatgagaaaggattcttaacaaatgtttaaaaataacatttctttttggtgttttaacacttaattttataaactgcagaacagcatctctaaatggctttttttttttttttaaagacaaagtagtattatgttgcttcagtttctttaaatacctcgtttcttttgagaccaaaaattcccatcaaggaaataaatcagcctgattttaacattttacatattacattgcctttaagcactatgattggatggctttttttctatttgtttaataatccttggctaaattcacatgtatctaaagtaaaatagctgagttactgaattctataaggggaagaaaaagcatttattttcacatgattaactgaaatggaaaagtaagacatttagcagaataattcatttaaaaataattttaaaaaatcagacatatttaaaaatctaggttgtctatccagtatgtgaatgcttaattataattgttacatgttgaatgggtattaagagtaagtcaccaggtacacaaaactgccatcatagcaaaatgagacagtgttgaaaagacaaaatattttctggaatgaaaatatattcaagttgatccatattcagatgttttctgtttaatacttcagattggtcctttgtccacatttgtttaaaacttattgtaatgttaatttatacttttggattgtgcctttgtcatgagttgagaaaagtagtcctacaaataatgtgaaagttgttaccaccacagcatgaatgtataattgtattaaaattgatcatccacagaag

SEQ ID NO: 78703 - DNA, 869 bp, Homo sapiens
ttaatttcttggtttcttcccagaattatattttaatgactccataaatacattccaaatattcagagattcatgagaaaggattcttaacaaatgtttaaaaataacatttctttttggtgttttaacacttaattttataaactgcagaacagcatctctaaatggctttttttttttttttaaagacaaagtagtattatgttgcttcagtttctttaaatacctcgtttcttttgagaccaaaaattcccatcaaggaaataaatcagcctgattttaacattttacatattacattgcctttaagcactatgattggatggctttttttctatttgtttaataatccttggctaaattcacatgtatctaaagtaaaatagctgagttactgaattctataaggggaagaaaaagcatttattttcacatgattaactgaaatggaaaagtaagacatttagcagaataattcatttaaaaataattttaaaaaatcagacatatttaaaaatctaggttgtctatccagtatgtgaatgcttaattataattgttacatgttgaatgggtattaagagtaagtcaccaggtacacaaaactgccatcatagcaaaatgagacagtgttgaaaagacaaaatattttctggaatgaaaatatattcaagttgatccatattcagatgttttctgtttaatacttcagattggtcctttgtccacatttgtttaaaacttattgtaatgttaatttatacttttggattgtgcctttgtcatgagttgagaaaagtagtcctacaaataatgtgaaagtgaccacaccttactcgacacacgggatcatctagagtcgccgcagc

SEQ ID NO: 78704 - DNA, 754 bp, Homo sapiens
aatatgtatttaatacttatttcatctttcttacctttcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacaaattcagctgctatgacaattttgtgaaaagtaacatgtttggtgccccagaacacaatactgactttggagcttttaagcacctttatatgttattagttaatgcttttaatttaagtcagaatagtttatcaaagaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgacgcatcttttactttgattggattcagtaaaggttgtgttgttttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaa

SEQ ID NO: 78705 - DNA, 2889 bp, Homo sapiens
  misc_feature (2889)..(2889): n is a, c, g, or t
gctgcgcgcggacgtcggcctctgacgtcgtcgcctcagcgccggctcccggccgggccgcggccgccgaccgttgagccgccggctgagccgcctgctgaagtccctccctcaggaacccctccgccaccctccacctccgaaccgctctcgcggcggcgacccatgtgggggttcaggctcctgcggtcgccgccgttgctgctcctgctgccgcagctcggaatcggaaacgcctcgtcctgctctcaggccagaaccatgaacccgggcggcagcggcggcgcgcgatgctccctctcggccgaggtgcgccgccgtcagtgcctgcagctttccaccgtgcctggagccgatccgcagcgcagcaacgaattgctcctgttggcggcggccggggagggactggagcggcaggacctccccggggacccagcgaaggaggagccgcagccgccgccccagcatcacgtcctctatttccctggggatgtgcagaattaccatgaaattatgactcgtcatcctgagaattatcaatgggaaaactggagtctagaaaatgttgctaccattttagcccaccggttccccaatagttatatttgggtgataaaatgttcccgaatgcatttgcacaaattcagctgctatgacaattttgtgaaaagtaacatgtttggtgccccagaacacaatactgactttggagcttttaagcacctttatatgttattagttaatgcttttaatttaagtcagaatagtttatcaaagaaaagtttgaatgtttggaataaggactccatagcatctaactgtagatccagtccttctcatactacgaatggttgccagggagaaaaagtgaggacctgtgaaaaatctgatgagtctgccatgagtttttatccaccatcactaaatgacgcatcttttactttgattggattcagtaaaggttgtgttgttttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctaacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatgagagtcaacatatatttgtttccaaatgtccacaagtgtacaatagtgtaaaggtggtttttaaaaacatagccaggtgtggtggcacgtgcctttagttccagctactcaggaggctaaggcaggaggattgcttgagcccaggctgtgtggttcaccataattgtgtttgtgactagctactgcactccaacctgggcaacatagtgggacttcatctctaaaacaaaacaaaacaaaattacacttaagcactattgtttaatttttaattgtcagtttatcattattttgggtaagacattctggggtttcttgaatcttgtccaaaaaccagttgttttggaaaattgctttaaattgagcatatttatgtatattggataaaaatgtactacagagcaaatttcaaatttttcattatatcagtctttttgaaaggatcaacttggataaaataaatatataatgctctatttgttagagctctattaaaaaggaaacagattccatagatctaagtcaatgtttctccagaagcatgattttgtctgccaaaagaaaatagctctctttggccaaaatgcaaaattacattgctataagaaaagttacaagggaaagtttgaagacacaaatgatttaattttggctcaaaaactgaatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaaaaaaaaattttgggcgctcggccgaaatttaaacatttttgggggccaggaaataaagggacaggtccaagaccggaaaggggtcaccaaaaacgggcggtaacaaggtgggctggttagatacccggn

SEQ ID NO: 78706 - DNA, 430 bp, Homo sapiens
tattattgaattgactagaatccctaatacaatagtgaattgaagtggtgaaagaaaagacctttgccttattcctgatcttagggtgagagcagtcagtcagtcttctgctattaagtgtgatgttagctataaacattttgtaaacgctttttgtgaggttgaggaggtacccttcgatttctagtttgctgagatttttttattaggaatagatgctgtattttgtcaaatgctatttctgtacctactgagatgatcacttggtttcttttgtaatctattaatatcacaaattacattaattgggtttcagttgttacactagccctgcatccttaagataaaccccatatggtcatgttgtattatccattttctgtgttgctggatttcatttgctaatataatattttgttaagaatttttt

SEQ ID NO: 78707 - DNA, 370 bp, Homo sapiens
tggtttataaggggagatgagattctcatctgtctgcaatggtttatctgaaattatctgaaagcgaaggaccagataaattctacactcttctcaaggcctgtgtaacgggctggatgttctcaggtttctgcatcaccacactcccagcacagtcacgcacggctgaaacctaaggctatagttaatgcctcttgcttcttgacctcacctggccagggagctccaagctcactgtgtggagagaggaaggaggattattaatcaaaattcattgaataaataaatgtcctaatctaatcaggttcaaatacacatcagcttagtcccaaaatacttcttacacataacttacacattactttctgcc

SEQ ID NO: 78708 - DNA, 782 bp, Homo sapiens
tgaactcctgatgtcatgatctccccacctcatgcctgtaatccctaaactttgggagaccaggatgggaggactgcttgagcccaggaatttgagaccaacctgggcaagatagtgagaccctatctctattaaaaaaaattaaaaaaattagccaggcgtaatggggcacacctgtaattccagctactcaggaggctgaggcaagaggttcacttgagcccaggagatcgaggctgtaatgagctatgattgggccactgcaccctagcctgggcgatagagtgagaccctgtcaaaaaaaaaaaacaaaaaaacgacagtgtccccagttctcagatctctggtttatgagtgacgctgcagcctctctctgatgagctgcaggctggggactgactcctcggcaggtctgcagtgggaacctgtggagacaaaagtgactccatcttggatgccactcccctgtgttgacttccgattcgccccagtcttgtgaatgccttctgatttctactttatttactgcccctagtgtaagaacatgtcaaccttgatgttactccacaaatcgtaggctgtgactcacgtagcgttcttgcctgttctggagggctgcctttggttgtcttgctggagcacgaataccctttccctatggtatctaagccttgcatctggggtgtgagaatgcagagctccacctgtcttgtggccacccaagatcccacttcggtctgtaaattccctcaataaatcacccaatattgacaaactggatt

SEQ ID NO: 78709 - DNA, 361 bp, Homo sapiens
tacacagttatcaaaaatgcagacacttcacttggcatctccagcaccttcagctttctgggcctggtcttttttggcaactccattttctgtagggttattcccctccttgccagcatcagcttttccctttttccctttgggtaccttctcaggggcctttttaggcttgctctggctttggaggagcaggtttagcagacaactttgtggatcttctctgtggttcatccttcaccttggcttcatctccttcagcatccccctcagcctttctcttgggcatgctggcaacaacagcgacgggacgtaggtgctgggcacaggatgtggtggtgtgcgggctttggtcggtccgggg

SEQ ID NO: 78710 - DNA, 976 bp, Homo sapiens
atgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggcttatgcctctaatctcagcactttgggaggctgaggcaggcggatcacttgaggtcaggagttcgaaaccagcctgacttatgtgatgaaaccctgtctctactaaaaaaaaaaaaaaatccaaaagttagttgggcatggtggcaggtgcctgtaatcccagctacttgggaggctgaggcaggagaatcacatgaacctgggaagtggaggctgcagtgagccaagattgcaccactgcactctagcctgggtgacagagcgagacaccatctta

SEQ ID NO: 78711 - DNA, 532 bp, Homo sapiens
aaagaacatgtaaggaaatgtgatatgagactctgaataggatgacatcagcccagcatgagggtcttgcatcactgttctgcaggattaaaagactaattaaattggcctatctaatttaaacataagcatgcatgaaaataggaaacattcatagagggtacatattaactcaagatgcttggccagacttctacaagagaaaagtaatgtatagaatttgtttgattagtgtttaaacaaagggggagaacctcatttcaatgtgctatcatgaaaggaatcttatacaaggaaacaattactgtcaagaaatgcaagtacttattgcatgctcttgtaggccctttagggattgttaaactgtttagaaccgaggatagcttttattttgtgaaaagacattttaatcatgtatgcaagaaaaaacacagtgattgtgagctgttaagtggatgaattacagtgtgtttggtaccccattgcttctcctacctactattgtcaatactttagtatttcatttaattaa

SEQ ID NO: 78712 - DNA, 520 bp, Homo sapiens
caaggacaattcttgagcccacggaaaacacaaaaggagatgtttagggaatagaccagagttaggagaccccagcatctgtcagcatctccactggaactcccaccctccactctgagtccttggagacttcatccctgctcggaatttctgtatttccactgttctgtaggacccctataaaagtcaaaggaaaccactcagagcctctgctcccaagggtctgaaaatcaaggaaatatggaatggggtgcccggaacacaagagggagatttgctgttcctggaacctgaagatgatactcagaaagtgttttctcataggcatgttgtaaataattgaatcatcctccaaggaaagtatatcgtgttaagtaagcatttgtgtaatcattattaagactttagaaacattggcttatgttaatgaatgcttaattcaaattgcaaaatactaagtagactgtatactcatgaatgttattgtaaaaagatataaatattaaagggcttggaagta

SEQ ID NO: 78713 - DNA, 1190 bp, Homo sapiens
tgataattaaatatatataaaggctttctgagagattatttactatatgaatatattttcagctggctgatcaaaagtatttttaaaattttgtttttagccattcaaaatgtatttgtattttcagaattgaatgcaagtcatacttagagctcaattaaaatactcttgcaagaaaaagcattaaattctctttgagaattccgtgaaatgcaaattaagggaaaaataggttttaagcagtagcaaaaacacaccgctaaaaatggcctttgaattctcagagctatggaaaaatgtgagaaactaaattgtctcgagatgtcaagatttttctatctccagttgctattggcctgtcctactgttgtctttgaatatttcctgtattccaccccaaaagatttcaacttttagtttttctatcactgggcaaggtcagactgggtttataaaacaatatattggcatattgtgattctttgtaattgactataaattggttttgaaatgtccaaacatacgttgtgtgtctttatattgtactgtgtgttttaagtaactggcagaaaaagaattggaaatgaaatttccaatcagacaatgtagtattaaagaaaactttgttttaaatatgcggtaccatgtaaaattactcgtgttaggaataaagtccactgttgaagttgaatgtcactaagcttattatgttaaaaggaaccagtgtgattaggaaaacctaccagaagccagatacagtgtggtacgtgcaacatttcatgcacattttgattttgtttgtcattcaaaattgtgcttgtaaaaatgtatacaatttctgagttttataatttctaggtacttgttttttcttgctggtaaatagcttttttttaaaaaaaaatctaatataaaagaaaccatgtttatattttgttagtgatcaatgactttgtttatatggaaatttgtatattgttggcacacattttgttgaggtttacgtgcatgaaggcctgcaataattagcacaatgaaaactgctttttcttacatgttcatttttttgaaagattgtggtgcaaaggcttactctaataagtaaccttctggactatggaatgaatataaatgaatggcactttgagtgttaataaagctaatatttatttccactgtgaaaaaaaaaa

SEQ ID NO: 78714 - DNA, 621 bp, Homo sapiens
ttgtactgtgtgttttaagtaactgtcagaaaaagaattggaaatgtaagttccgatcagacgatgtagtattaaagataactttgttttatatatgctgtaccatgtataattactcgtgttaggaataaagtccactgttgaagttgaatgtcactaagcttattatgttaaaaggaaccagtgtgattaggaaaacctaccagaagccagatacagtatggttgggctagactggctatggtcagccgtggggtctatttcacaactagattggcacttattgtccatcatttgcgaattgacgactcagtgccttcggctaggtccaaacatacgttgtgtgtctttatattgtactgtgtgttttaagtaactggcagaaaaagaattggaaatgaaatttccaatcagacaatgtagtattaaagaaaactttgttttaaatatgcggtaccatgtaaaattactcgtgttaggaataaagtccactgttgaagttgaatgtcactaagcttattatgttaaaaggaaccagtgtgattaggaaaacctaccagaagccagatacagtatgttgggctacggtatggttggcactattcggggatactctagaac

SEQ ID NO: 78715 - DNA, 1135 bp, Homo sapiens
tgataattaaatatatataaaggctttctgagagattatttactatatgaatatattttcagctggctgatcaaaagtatttttaaaattttgtttttagccattcaaaatgtatttgtattttcagaattgaatgcaagtcatacttagagctcaattaaaatactcttgcaagaaaaagcattaaattctctttgagaattccgtgaaatgcaaattaagggaaaaataggttttaagcagtagcaaaaacacaccgctaaaaatggcctttgaattctcagagctatggaaaaatgtgagaaactaaattgtctcgagatgtcaagatttttctatctccagttgctattggcctgtcctactgttgtctttgaatatttcctgtattccaccccaaaagatttcaacttttagtttttctatcactgggcaaggtcagactgggtttataaaacaatatattggcatattgtgattctttgtaattgactataaattggttttgaaatgtccaaacatacgttgtgtgtctttatattgtactgtgtgttttaagtaactggcagaaaaagaattggaaatgaaatttccaatcagacaatgtagtattaaagaaaactttgttttaaatatgcggtaccatcttattatgttaaaaggaaccagtgtgattaggaaaacctaccagaagccagatacagtgtggtacgtgcaacatttcatgcacattttgattttgtttgtcattcaaaattgtgcttgtaaaaatgtatacaatttctgagttttataatttctaggtacttgttttttcttgctggtaaatagcttttttttaaaaaaaaatctaatataaaagaaaccatgtttatattttgttagtgatcaatgactttgtttatatggaaatttgtatattgttggcacacattttgttgaggtttacgtgcatgaaggcctgcaataattagcacaatgaaaactgctttttcttacatgttcatttttttgaaagattgtggtgcaaaggcttactctaataagtaaccttctggactatggaatgaatataaatgaatggcactttgagtgttaataaagctaatatttatttccactgtgaaaaaaaaaa

SEQ ID NO: 78716 - DNA, 684 bp, Homo sapiens
  misc_feature (562)..(562): n is a, c, g, or t
  misc_feature (566)..(566): n is a, c, g, or t
ggtgttgcccgccccgcactcggagcccagagccgccgcccaggaaggggatgcggaaacccctggctcggtggagcggagaggcaggcggggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgcaaanacancaccaacacacaaacaaaaagaaacaacccagcacctggaggggactgaaaaaactacaaaaaggacaaggcccgcagccagaaaacgaaaagacggacactggacaaaggccaagaa

SEQ ID NO: 78717 - DNA, 794 bp, Homo sapiens
  misc_feature (672)..(672): n is a, c, g, or t
  misc_feature (676)..(676): n is a, c, g, or t
gatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatcttatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacacccctgctccccactgccgctgctgcctcaataaatctgctgatttgcaaanacancaccaacacacaaacaaaaagaaacaacccagcacctggaggggactgaaaaaactacaaaaaggacaaggcccgcagccagaaaacgaaaagacggacactggacaaaggccaagaa

SEQ ID NO: 78718 - DNA, 329 bp, Homo sapiens
gcagcagcagctctttagccaggaggctgccgatgagatctgcaagaggtgaccgtcacccaccccagcccctggagcagcagagctctggcggagtgacccacctgggtctcgccgccaggcaggcgctgagccttgggggctttcttctgctccgcgctcacttgcctaagctagacgctgggactctggggagatgttgcctcctgtgcctgtctgtccctgtggcctcagccccagccagacctcaatccagtggttctttcttttttttttttttttgagactgagtctcactctgttgcccaggctggagtgcagttgcgcga

SEQ ID NO: 78719 - DNA, 973 bp, Homo sapiens
  misc_feature (851)..(851): n is a, c, g, or t
  misc_feature (855)..(855): n is a, c, g, or t
ggtgttgcccgccccgcactcggagcccagagccgccgcccaggaaggggatgcggaaacccctggctcggtggagcggagaggcaggcgggcaggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgcaaanacancaccaacacacaaacaaaaagaaacaacccagcacctggaggggactgaaaaaactacaaaaaggacaaggcccgcagccagaaaacgaaaagacggacactggacaaaggccaagaa

SEQ ID NO: 78720 - DNA, 338 bp, Homo sapiens
atgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaatacgtcaatatcactttttgtccatattaacctaaaatttaatacagttccagcataagctgtaatgttatttttattctatgaaatttgataaaatacggtaaagttcagaaaaacattgcctgagactagtgaagaatgaaaaa

SEQ ID NO: 78721 - DNA, 665 bp, Homo sapiens
ataggaaaataatgtagttcaaaaaagtatacagtgacagtgcctctttgctacttctgattcccaatctcccagctttcctcagaagtaaccactcttacgtgtatacctgtttgttgtatgttattatttgtgtgtatccttttttcctgcccaaacctatacttaacgtgttaagagtatattagcatttatggcatatgatcttataattctttttttcctatattctgtgatgtgttaactaatttaatctattattactaaattagcactttcggcataatcaaatttttagctttaaacaactaatttaaccttgagatttttgaattatatatgcctaggattctggagccacgtacactgttaaatattccaagaaaagtccactgttcctataatgtgtcattgtatgtggctccagaatactaggttctggttggtttttaccatcatttacttggatttcaacaaggtatagcatttgtgttttaccatccacgttaagaaattaaatttcccctgtatttgaaacatcttttcctctcagagttaattgctgttatatatcatttcctatgcactgggaactgatgaatatattttttgatagaatacattatctgataaccaaggatttgagtcttctaagcccatgacaa

SEQ ID NO: 78722 - DNA, 374 bp, Homo sapiens
atgccccacgcctatcacttctctttccatccttccctcccacagtggctaaagaagggaagggagaaggaagggtattggaaagtccacacctgactggatgttttcagctctcagggtctggaagatatttgaagatgactatctcatgggcactctcacaggctctacgaaggttgtctgcattgggaacctccactgaagatcccagtaagtcggcaatgcatcaactttggggaccactccccaccaggctcccaccactgccattcgtttgctctgattctggctactggagtcatgccattctccaggagttcctgcggatcgagagcagaatttaacattagcctggaaatctcacaccagagagt

SEQ ID NO: 78723 - DNA, 619 bp, Homo sapiens
ggcacagggaggggaacatcacacaccagggcctgtcaggggatggcgggcaaggggagggatagcattaggacatatacttaatgcatgtggggcttaaaacctagacgacaagtcgataggtgcagcaaaccaccatggcacatgtatacccatgtaacaaacctgcacgttctgcacatgtatcccagaacttaaagtataattttaaaaaatttaaaaaataaaaaataaaataaagtcttgtttcagggtaatattaatttgcgttaccacctatttcaacacggcagacaattgtaccatctgagacaaatggagctttgacatgaaatcttaaaataccccataaatggtggccgggcgcggtggctcacacctgtaatcccagcactttgggaggccgaggcgggcagatcacagggtcagtagatcgagaccatcctggctaacacggtgaaaacccgtctctactaaaagtacaaaaaattatcggggcgtggtggcaggagcctgtagtcccatctactcctgaggctgaggcaggagaatggcgtgaacccgggaggtggagcttgcagtgagccagatcgggccactgcactccaccctggtcaac

SEQ ID NO: 78724 - DNA, 512 bp, Homo sapiens
aagaaaatgatgctaacaaagttcaaagttgctccgtgttgcagtgatcttttaaaagggaagttttgaggtagttttgaagcagatttctggaatcatcttcaggactttcgtgagctcattgtaatgtgttatgtgaaatgcatgtcctcaaaacatgggtggttgtataaatgaggaagctggcctcatggagccaaagcagcatggaaaggcccaaataacttgctgtggggaagactgactgcctctggggtttttaatcagcatgaaaagccacccagggccccaaatcattagtagcattttaattggcagcagagtaatactgtgtctactttggcttacagatataaatttcctgctctctcataacagatggtgatgaggtgcatggtaggaagcatggcaagaactgtgttactcaaaatgtagacttaattgcaaatttgaaatggaaataaagtgaaggttctgtctttatttacaataaatttcatgtgttaaatgga

SEQ ID NO: 78725 - DNA, 618 bp, Homo sapiens
cagtgcgggggggatagctagttattgtactaacttcttgcaacagtttcttaattgacgtatcaggtgacaggtctcacagagtcaccaaggccccactgtgatacttctccatgtatttattggcttgtaaatgaatgttcaaatatatcacttaggttcatttgattaacgaaagcaagggctggctgtaataaataaacgctcacagaatggcttagtgaaggaatttgaatattcctagcctcccagacttcgcttggcagggctgggggtcgggggagtcaaatgtgtggctaataaaagtgacttttgactttgagctctattcagaagtaattctgcaacatgaagccttccagtattctcccttcaccttgaacatttctctcctgctgctcttcatttgctgcctggtagtcagtctggagctgctttcatctctgttgctgccggtgctcttggcctagtacaagcttgacctcttagcagctggagttgacttagttattctcctagcattctctgagtgacttggttgctcttacagcacttcagattagctttgctgatgtgaaaggtcacttttcaccaatattaaaacttattaatcttcaa

SEQ ID NO: 78726 - DNA, 279 bp, Homo sapiens
gctcagaagccagcacacgaaggcctgcaactgcagacccctaagaaaccttggagatgctctcagacagtgcccacctcactttgcagatggagtgactcacagctgggacaaaggtccactcgctcttgcccctgcagtctacccacaaagcagccaggagagcttctaaaaatgcaaagcaggtggcgttcttctgaataagccctcccatggctccctatcttagtacaaaagctgaaatctcatgacctgtgaggccctccagctggctcgcag

SEQ ID NO: 78727 - DNA, 304 bp, Homo sapiens
  misc_feature (9)..(9): n is a, c, g, or t
  misc_feature (31)..(31): n is a, c, g, or t
ccttgccangacaaccattctactgttgctngagctcgtcgcgaagggaaagacctaaacaagagggaagaaatggacatttcatgccaagatttcttcccttcacctcacactcgagttcctgggttctgacggccttttttgaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaa

SEQ ID NO: 78728 - DNA, 710 bp, Homo sapiens
gtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaa

SEQ ID NO: 78729 - DNA, 612 bp, Homo sapiens
aataaataatcattcattcttttattcagttggtaataatgtgaatgtttagtgagtactaagctcttactgtgtaccctagtatgaagagaataaaaggatgcacaataaatatacatcccctaatcagagacagtttcaaattttagtttataatttgtaggtgttcctcctcacagctatatattagaatcatatgagaatgagtgaggaaagccaaaaaaacaaaaggatcatcgagaagcataaaacaaaaagattaggagcggtgagaggcaggacccaggcttggtattgttatgttttaaataattttctaaagttttgaattgtaaaaaaagcatgcatggaactgaccatcatagccatgttaagtgtacagttcagcagtattgagcacctccacattgtcgtgcagcggaactccagaaattctccgtcttgcaaaactcagcctctgggccgttaaactaggtgtccccacctcccctcccccaggccctggtgaccaccgttctgctttctctgtctgtgattttgaccactttagatacgtcatttcagtggactcatcctgtgtcgttttgtggcggaatcacgttctgttgtgtg

SEQ ID NO: 78730 - DNA, 411 bp, Homo sapiens
tgtcattatttaagatgggggacatccaagcacctggaacaaaaaggacactaagaatgggagaagaatacacaaagggaggtagtacagggccaataacagatttttggaatttttcaaatttctctttgaagtaattttacagtcagtaaatggaagtggaaaagaggaatagaagagcatttcattgattttttttttctcttgtacttacacatctcatgacctcatgttcccagaacttaacacttagttgggttctagtagatattttgggttgaaaagatgtttgctgttttgcattttgttctgttttgttggctagcctgtgaatctagcattgtacgtgagaaagtgcatttcagattgaaagcaactggtttggaaatgaacttcaataacatatcccag

SEQ ID NO: 78731 - DNA, 216 bp, Homo sapiens
tttcttaccagcctccccccaatgaggtaagaccgttttcaacaatttgctaatgctcttgtggcgcccggtgggggtcggaacctgagatcccgaatcgctgtgtgtgtgtgtgtgtgtgtgtgtgtgtgtgtgttgccactggacagttgatttattttccaagctgctctctctgcctgccgtgcaagggacgcgcaaagggctagagaggtt

SEQ ID NO: 78732 - DNA, 281 bp, Homo sapiens
ggaccatgcagctctagaattatttcttagaggacaagaaccagccttctgcagtttgaagaaatccagataccaggaaatattcatagcatgaatttaaaatgagataataagggagggaagtttagggtcagactgaccctgtgcccaggagctggcaaggaagacctttccttggctttgtcactggagaggggctggtgaaggccagggtttactgagggggcatagagaaataaatcctctagaagtagcttgaagcaggcctcgaaagactgttg

SEQ ID NO: 78733 - DNA, 323 bp, Homo sapiens
gactaccggcacgccaccacgcccagctaatttttttattttcagtggagacgaattccaccatgttggccagaatggtctcgatctcttgacctcttgatctgcctgcctcggcctcccaaagtgctgggattacaggcatgagctaccgcacctggcccaaagcattttcagtagccataaagttgctttttaaagacacagcaaagcggtattagacttttttttttctttttttgagacggagtcttgctctgttgcccaggctggagtgcagtggtacgatctcggttcactgcaacctctgcctcccgggttcaagc

SEQ ID NO: 78734 - DNA, 365 bp, Homo sapiens
gttgtaaattcccaaggctccgtactaataaaaagtttctggctgccttttgggccccagccctatgccctgggtctggctcccaaatttgcagaaatgtgtgatttcttggggtgagacagggtggatcttaaaactcacggtctccaccccagggaacttgatgcagggtcctggagtctgcaggatctagtactgcagttaaaattcacagtctggttttagctcactttttaactgaactgtatgtgatgctgttggaaaagcttgaacttgggcattagaacctttcccctctctggaaatcttctttcacagagagagaattttagagccaagctaggttgggggactagacagatggt

SEQ ID NO: 78735 - DNA, 4682 bp, Homo sapiens
cacaaattccctctgtctcctccagaatccagaaaagaataattacgatattttcaaaatggaaagttcccatgccaaagactttgccttcttcaccaaactatgatttcgtgatgttcttaaaggtagtgtacaccaggtttttacattcttattttgaatgtagttttagtgtttgtgtgatttgtttttcagcctggcctgcagactagcaacccaagacttatactgcccaatttgacagctcatttttattttagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaaacaggaaaaacaccagcttcatgttaaaagtaacacagtatgaccaggataagacgttactgattatgaccaacaacccacctccctgctcaatcacccagcaagacaaggagagtgcatcaaaatatttttccaaggagttactgctcaaggtcatggaaagtcatcatcagcacaaacccactgagaacctctggctgccccgcatgcctcagaaaaaaaagttaagatctaagctgaaaccaatcttccctttgatactgtcggatgatcccacatccaagcgagaacaatggtttaggttttccactgacaatgatttcaagagcgaagggaagtattcaaaagtctacgctttgaggacacagaagaaaatgtaccctcagctcacctttgctccagtccatgagagagatatgaggaaagatgcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgctgctgcgggcgtgggctcccgggtcgcaagccgggagggtcgagccgaagtctccggcgggccgcaagaggagaagggggcgtggctgcgtcccgggggccgagggcggccggggagggcgggccttggccccgagtgaaggcgcggcggcccaaccggcgtgagagcgcggggccggccttcctgcagcctcttccgctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcagcttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacagtctctgtaccagggatgggaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatgcctttgagaaagaggaaacctttgccctcagttctaccaaaacccttgtagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaacgactttggagaagcaaattaaacatttggccctgagccagcagatcaagcaaatgtctatctttgcgcatgggttgttttttttttttttttctttttattctacttggtcagctttgggacggtagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttc

SEQ ID NO: 78736 - DNA, 3099 bp, Homo sapiens
ccctccgagccgcctcctcccctgcgcgcgggcctccggcgggggccgagggcgtgcgcgcgtctccgcgtccaggggtgctggtagggtcggacccctagtgggagcaccctgttcccggggctggggtcgacggcacagggtgtgtgtggaggaacgttcaggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgattctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcagcttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacagtctctgtaccagggatgggaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatgcctttgagaaagaggaaacctttgccctcagttctaccaaaacccttgtagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaacgactttggagaagcaaattaaacatttggccctgagccagcagatcaagcaaatgtctatctttgcgcatgggttgttttttttttttttttctttttattctacttggtcagctttgggacggtagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttc

SEQ ID NO: 78737 - DNA, 465 bp, Homo sapiens
tccagtccatgagagagatatgaggaaagatggtaagctcctctctttcaaagcaaaggcttactggactgagatttgggctggagatacaatccatgaggattatagatgtggcaaactggcttctctcgtggtagtcctggagactatttttccctatagcatggaagttaacaacaaatagaggctcaaaaggtgcaaagctctggaccctgtttaaatcctcaaatttcaagaaagctctagcagtgtttactaagctatatcacccagcactttaatagtttttgccatattgatgtattatttgctgttaatttacttagcattttttaaaaggatttttaaaaaatcttgtcctaattaatactatatcattgatatcatggttttgatgtacaaattatatgcttttctgaaacacttatatcaaatttataataatgaaattttaaaatgtttatc

SEQ ID NO: 78738 - DNA, 678 bp, Homo sapiens
  misc_feature (22)..(22): n is a, c, g, or t
  misc_feature (46)..(46): n is a, c, g, or t
  misc_feature (587)..(587): n is a, c, g, or t
  misc_feature (620)..(620): n is a, c, g, or t
gggggcggggcgcggggggggngcggggaggggtgggcggcgggtngcgtgacgtggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaattgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaatttatgctagtnttctgaggtgctgattgaactatgactaactanaacagatctcaaacttgctgtgtgttacattaagacagtgtgatactaggtgactgaa

SEQ ID NO: 78739 - DNA, 5636 bp, Homo sapiens
agaggagaccagcaagcagagccctcagatgctcggagctttctcggcgcgaagctgcccgtcgccctctcctgccgccctcgcccgccgccctcctgctcctgctccggctgcggctcttggtaccccggctccgggagcccagctccccgccaccgccgccgcctgggtgtgggggctgctgaggctgagccgggcctcggcgccggctctgaggacggacgcctgaggagctgcgcggcgcggcgccgccggctggcggagaacgcccacaggcgcggggctcggcggcttgacccgggcttgtccccgtgcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcgagcgcttcatcgagccgcacgagatgcagcagccgctggtggtcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggagggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaagtttatttacaaaatatataagtatttttaaggatgttgacacctaataattacatgctaaacgcaaacgattaatgtaatcttttaaaccgggcgtttgaacaaaaaattttcaaggtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 78740 - DNA, 3550 bp, Homo sapiens
  misc_feature (26)..(27): n is a, c, g, or t
  misc_feature (31)..(31): n is a, c, g, or t
  misc_feature (35)..(35): n is a, c, g, or t
gaagccttgagaataatccccccccnncggngtantgggctataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaagtttatttacaaaatatataagtatttttaaggatgttgacacctaataattacatgctaaacgcaaacgattaatgtaatcttttaaaccgggcgtttgaacaaaaaattttcaaggtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 78741 - DNA, 2969 bp, Homo sapiens
  misc_feature (24)..(24): n is a, c, g, or t
ccagtctggtccgccccggggtanggcatatagtcggacccacgccctcgcccatgcgtcagggagaaatttcaatgtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 78742 - DNA, 1815 bp, Homo sapiens
  misc_feature (22)..(22): n is a, c, g, or t
  misc_feature (46)..(46): n is a, c, g, or t
gggggcggggcgcggggggggngcggggaggggtgggcggcgggtngcgtgacgtggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaattgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 78743 - DNA, 1540 bp, Homo sapiens
agaatatgtgtttagaaacttgtctgttgtctcagtttagtgaaaaggaggtgctgcatgtgcctgaattaaaactgatgcagtgttataagagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 78744 - DNA, 2331 bp, Homo sapiens
agaggagaccagcaagcagagccctcagatgctcggagctttctcggcgcgaagctgcccgtcgccctctcctgccgccctcgcccgccgccctcctgctcctgctccggctgcggctcttggtaccccggctccgggagcccagctccccgccaccgccgccgcctgggtgtgggggctgctgaggctgagccgggcctcggcgccggctctgaggacggacgcctgaggagctgcgcggcgcggcgccgccggctggcggagaacgcccacaggcgcggggctcggcggcttgacccgggcttgtccccgtgcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggagggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactgga

SEQ ID NO: 78745 - DNA, 546 bp, Homo sapiens
ccagttacaacagctccagttttaacagctcagctacaacagctgccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 78746 - DNA, 5804 bp, Homo sapiens
agaggagaccagcaagcagagccctcagatgctcggagctttctcggcgcgaagctgcccgtcgccctctcctgccgccctcgcccgccgccctcctgctcctgctccggctgcggctcttggtaccccggctccgggagcccagctccccgccaccgccgccgcctgggtgtgggggctgctgaggctgagccgggcctcggcgccggctctgaggacggacgcctgaggagctgcgcggcgcggcgccgccggctggcggagaacgcccacaggcgcggggctcggcggcttgacccgggcttgtccccgtgcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggagggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaagtttatttacaaaatatataagtatttttaaggatgttgacacctaataattacatgctaaacgcaaacgattaatgtaatcttttaaaccgggcgtttgaacaaaaaattttcaaggtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 78747 - DNA, 5742 bp, Homo sapiens
agaggagaccagcaagcagagccctcagatgctcggagctttctcggcgcgaagctgcccgtcgccctctcctgccgccctcgcccgccgccctcctgctcctgctccggctgcggctcttggtaccccggctccgggagcccagctccccgccaccgccgccgcctgggtgtgggggctgctgaggctgagccgggcctcggcgccggctctgaggacggacgcctgaggagctgcgcggcgcggcgccgccggctggcggagaacgcccacaggcgcggggctcggcggcttgacccgggcttgtccccgtgcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggagggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaagtttatttacaaaatatataagtatttttaaggatgttgacacctaataattacatgctaaacgcaaacgattaatgtaatcttttaaaccgggcgtttgaacaaaaaattttcaaggtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacaga

SEQ ID NO: 78748 - DNA, 710 bp, Homo sapiens
cgagcccggagacttgccttgcaatgccatgtttgtgtatgtgctctaactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaagaatagaccagaggactgccatttcgccaaaggatgcttttgaaactcggcaggacttaaatgaggaagaagctgctcaggtgcatggagtcaaggaccggcgccagatcaacccagagcgtgcttgccgatgggacagattctgcagaccctcacagtccacaaagatggg

SEQ ID NO: 78749 - DNA, 895 bp, Homo sapiens
gcaccatgaagaatggtgtttcctaaatgaaaagttcagatactgctggtaaagaaactggaaaaactgaaggaaggaataaaatatgttggtggtattaacacctccagtaagataagtcattggtacggtttttctaagggccgcagtgagatgtagcagaagaaatatgtttattttgggcaaagatttgcttattggcctgggattgcacattttctctgatgtttgcaacagagaaattttcattttaatgatactcttcctttcttgaaagttacatgtcctcatttctgtttctgcttctcccttggccagtgtcattgatgcagatcattgcatacaacagcacagcaaattgtgccaagtcagtgtgtgaatgggaattagcaatgcacgcttgcaggctctttttccaggaaccaggctgtaacattgaccggggaacctcttcattccctgacatactaaattggtcaattttgtagtactcacctccatccacaaaaacaacaaagataaaatcaatttggagctttatatgacaaaaaggaagaagtccaaaaatatatagccttcccccctcccacatatctgatccaaatattaaatatctgattttataaaacagtttaaattgtctttttaaattgctaacaagcatcagttatatttgagcttcatttttcttttatcctgtctgtcctaataaaaacaaaaatggccaaaaggtggagaggaaagaaaaagcttccactttttaaaatttgttttgtattagttattttacctttagggaccctacaactgaagagagtggagagaataaagaagtgaactttcattcatgtctgctactttgtcctcataaagaaatctgcaacacagatgaaac

SEQ ID NO: 78750 - DNA, 823 bp, Homo sapiens
agtgtccagttgtgttgctgctgctgttgttaatctttagtaccagtactatgtatgaagtagtactaaagaatctgtctttagtaccagtactatgtagtagtactaaagaatctgtctttagtaccagtactatgtagtagtactaaagaatctgtctttagtaccagtactatgtagtagtgctaaagaatctgtctttagtaccagtactatgtagtagtactaaagaatctgtctttagtaccagtactatgtagtagtactaaagaatctgtcttagtatacacagtactggtactaaaggcactatgaagaaggccaggcatggtggctcatgcctgtaatcccagcactttgggaggccgaggtaggtggaccacctggggtcaggagtttgagaccagcctggccaacgtggcagaaccccgtctctactagaaattcaaaaattagccaggcgtggtgccgcgagcctgtaatcccagctactcgggaggctgaggtgggagaattgcttgaagccgggaggcggaggttgcagtgatccgagatcgcgccactgcactccagcctggacaacacagcgagactctgtctcagaaaaataaataaataaataaataagatactatgaagagacactgggattcttcaatgaagagcaaggcaaggacagcaacgataacttgggggatttgccagtcggcaagagccacttctagagcttttatccattttgaaatcaagagattactggctttgttataactttaaaagcctttgaaattgcctcacataataaatgtagttcgaaaaaaaa

SEQ ID NO: 78751 - DNA, 515 bp, Homo sapiens
  misc_feature (307)..(307): n is a, c, g, or t
  misc_feature (386)..(386): n is a, c, g, or t
aaaaataaaggaaatattatatagtcttttgtccacaaaggggtagtcaactccttttgagcataaggaatctttctgagaatctagttcatggtagggaaactgccattgcagcaacagagctcattaaagctaaggtagtagtcttaaaatttaagagaatctcaattataaagtgatggtaaagatcagtagtaagagtttctttcctctgatcataggttctctagagaagacaaataactaagtgttctgcattgtgtacactagtgtacagagtgtctaaatggtgttatttttgggaagngaccctgtagcagtcagtgtctgaaatgtggataagggctgaaagaataaaagaaccactgttgttgacgagggtattnctagtgccactttggtatgctgctgacatttggtctcagctgataagtttcaggaacattttattgaatgatctgtgtaggaatgttttggtatcacgcttaagggaatacatgcatttatagccatca

SEQ ID NO: 78752 - DNA, 796 bp, Homo sapiens
tctgaagggccaagtcctgcaagaaatgtctaatattctaataatgaaaggaagattgtcattcacataatatagatacatgttatagcgtataagagctagaagggttccaacctcattttacagataagcaggtgtccaaattttatagcttttggttacagaattggactggaaacccttgccctttatattactgtctcccatcattctctgttgtaaatctgtttggccttgggttgatggcacagatgggcccaagctgcagatgaccttcagataacatatgaaaatttaactggcgatgtcctagtatcagcaggagtaatagcttaccttggtgctttcacttctggctttcgacaaacatgtacaaaagattggagcatgttgtgcaaggtaatggtttatatttggtaagtcttgttttagaacatccaaagtatgtttggggatatttgggggaaaaggatgataataatggcagaagagaagaaataactgaaaacatggggtctttcttttttggcttcttgtttcatcagtaaaatacttccactattcaacttttaatttcttttctttctgttccttagagttattaaataaatgcctagtgacaattaaacccaatattttaatttaaaaaaatatttcagttaacaaggggaaggaaaatagatttggggataattcttacagaagaaaaaaatcccgtgttcagaggagttcctggtggagtaaacccctgggtgatccagtaaaaattagagcttggaatattgctggtttacca

SEQ ID NO: 78753 - DNA, 490 bp, Homo sapiens
ttgatcaaaagtatttactaagtgagtgacaaaaggcactagcaactttaaggattttgcctattagtatcatatggcatgtagctatcaagccagtttcgtttagttattttgtgttgccaagcatatgatacgtggtgtcacactgagcctttgggatcctttccctggatacataaccctagtagataatgttactgcaagatgtaatgaccaaatccaacctactgcaaatgttactatggaaatctcaatgcaaaagtagcctttgtgattttttttttaaaccgtctccataacagaacacttagaattattagccatttgctgcaaagtatttgttttaaaatgtctggcatatacaccactaacatttaaatgcccaacattcggtctatatgtgaaaaaactagaagaaaagccctgttggagttttgatgtagagtgcaataatacatcaataaaggtattttaaaatgaaaaaaaaaat

SEQ ID NO: 78754 - DNA, 3775 bp, Homo sapiens
atggagcggctgcgggacgtgcgggagcggctgcaggcgtgggagcgcgcgttccgacggcagcgcgggcggcgaccgagccaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78755 - DNA, 3923 bp, Homo sapiens
gattgcgcgggcacatttctgtcttggtagcgattcgtcaatgtcgtctggtagtgccgtgtgcgggcgcgcgcgccgatggatgctgtgcttgcgggggagcggatgctggtgatgctggcgtgctaggcgatgaggacgcgcggctgtttccggacgggtcagccgcggtgtctgtgtcgacgcggaggcctatggtgcgggctgcccaggggccgaggggctgagggcgcggcccgcggctgacgcgttccctttacaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78756 - DNA, 4104 bp, Homo sapiens
gattgcgcgggcacatttctgtcttggtagcgattcgtcaatgtcgtctggtagtgccgtgtgcgggcgcgcgcgccgatggatgctgtgcttgcgggggagcggatgctggtgatgctggcgtgctaggcgatgaggacgcgcggctgtttccggacgggtcagccgcggtgtctgtgtcgacgcggaggcctatggtgcgggctgcccaggggccgaggggctgagggcgcggcccgcggctgacgcgttccctttacaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggggaacctggggtaagccacaggggtgtggaggggctgtccccgcgtccgctgagccctgctctgcccccagccatcgagactttgctgtgctacctggagctgcacccacaccactggctggagctgctggcgaccacctatacccattgccgtctgaactgccctgggggccctgcccagctccaggccctggcccacaggtaagcacgccctgcccagttggagacgaggttggagaatcagggctgttggccacatgtccctttttccctgggcacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78757 - DNA, 4043 bp, Homo sapiens
gattgcgcgggcacatttctgtcttggtagcgattcgtcaatgtcgtctggtagtgccgtgtgcgggcgcgcgcgccgatggatgctgtgcttgcgggggagcggatgctggtgatgctggcgtgctaggcgatgaggacgcgcggctgtttccggacgggtcagccgcggtgtctgtgtcgacgcggaggcctatggtgcgggctgcccaggggccgaggggctgagggcgcggcccgcggctgacgcgttccctttacaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtgcggcatggacagagctggtgtccccgtggacccaccttgggcacacatggtcccatcccactgaccatctgcctgtcttccccaaaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78758 - DNA, 3085 bp, Homo sapiens
gattgcgcgggcacatttctgtcttggtagcgattcgtcaatgtcgtctggtagtgccgtgtgcgggcgcgcgcgccgatggatgctgtgcttgcgggggagcggatgctggtgatgctggcgtgctaggcgatgaggacgcgcggctgtttccggacgggtcagccgcggtgtctgtgtcgacgcggaggcctatggtgcgggctgcccaggggccgaggggctgagggcgcggcccgcggctgacgcgttccctttacaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggggaacctggggtaagccacaggggtgtggaggggctgtccccgcgtccgctgagccctgctctgcccccagccatcgagactttgctgtgctacctggaacgaggaggctccaaaatgcagaataaaaaatgctcactttgtttttatgggc

SEQ ID NO: 78759 - DNA, 392 bp, Homo sapiens
gcgggccctgcctggagcagcaggatgaggagcgcagcaccaggctcaaggacctgctcggccgctactttgaggaagaggaagggcaggagccgggaggcatggaggacgcacagggccccgagccagggcaggccagagtgagtgcagtaaggccaggcagctcatcggggttgcaggttccctgggctgcatggggcttgctctgtggatgcagtgccacgggagctcagaggaagcctgatgtgcctgtccacacagctccaggattgggaggaccaggtccgctgcgacatccgccagttcctgtccctgaggccagaggagaagttctccagcagggctgtggcccgcatcttccacggcatcggtgaggcctgggaggccccacc

SEQ ID NO: 78760 - DNA, 741 bp, Homo sapiens
acataggctggtagaggcgggtggtaaatcagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcctgttgagctgtgaagaaacgtttcaaaacctcaatcctat

SEQ ID NO: 78761 - DNA, 3953 bp, Homo sapiens
gattgcgcgggcacatttctgtcttggtagcgattcgtcaatgtcgtctggtagtgccgtgtgcgggcgcgcgcgccgatggatgctgtgcttgcgggggagcggatgctggtgatgctggcgtgctaggcgatgaggacgcgcggctgtttccggacgggtcagccgcggtgtctgtgtcgacgcggaggcctatggtgcgggctgcccaggggccgaggggctgagggcgcggcccgcggctgacgcgttccctttacaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78762 - DNA, 2220 bp, Homo sapiens
aaggctagtacgagactggtgtgaatcggccgagcttcccctgctgttaatcatggcatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78763 - DNA, 3514 bp, Homo sapiens
gattgcgcgggcacatttctgtcttggtagcgattcgtcaatgtcgtctggtagtgccgtgtgcgggcgcgcgcgccgatggatgctgtgcttgcgggggagcggatgctggtgatgctggcgtgctaggcgatgaggacgcgcggctgtttccggacgggtcagccgcggtgtctgtgtcgacgcggaggcctatggtgcgggctgcccaggggccgaggggctgagggcgcggcccgcggctgacgcgttccctttacaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacggaacctggggtaagccacaggggtgtggaggggctgtccccgcgtccgctgagccctgctctgcccccagccatcgagactttgctgtgctacctggagctgcacccacaccactggctggagctgctggcgaccacctatacccattgccgtctgaactgccctgggggccctgcccagctccaggccctggcccacaggtaagcacgccctgcccagttggagacgaggttggagaatcagggctgttggccacatgtccctttttccctgggcacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78764 - DNA, 831 bp, Homo sapiens
gattgcgcgggcacatttctgtcttggtagcgattcgtcaatgtcgtctggtagtgccgtgtgcgggcgcgcgcgccgatggatgctgtgcttgcgggggagcggatgctggtgatgctggcgtgctaggcgatgaggacgcgcggctgtttccggacgggtcagccgcggtgtctgtgtcgacgcggaggcctatggtgcgggctgcccaggggccgaggggctgagggcgcggcccgcggctgacgcgttccctttacaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacaagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgtttttatgggc

SEQ ID NO: 78765 - DNA, 611 bp, Homo sapiens
agaggatccccgtctgtgactacccatttgagtgaaagaaaatcttgttaacgtctgttagtcattatgggttctcttaacttttacatggtcaaagtaagcttgtagtaatattgttttacaatttagatagatgagtaacaaccaaagttagcaaaaatatctctatgtcatttgtaaaagttgaagtttatagagactgtgacttcaataaatcatgtaaaaataaaaacattgacctatgatttttaaagatactaggataattatattgattactaatgaatctctgatgaaaataaattatattgcatatgtaatctcttgacattaatgaattattttctgttctattatatgattatttgtgcttcttttctaggaatggaaagaacgttatggacacaatagagaagattccactaggaacagaaatattcatactgaccccaaagagtcaaacttctcagatgttaataccaaccgttgtaagtagtttatcttctagttcacttggaaattgttttcttatgctttcttgcatagagattgagtgttagaatacacacatccagaaatgcctctgtagcattatacaatggtatatctgc

SEQ ID NO: 78766 - DNA, 1582 bp, Homo sapiens
tggtcagagtgcacattctttagcactactcctgtcttatccctctttgcggtcttcatacagctggcagaaaaaacatataattatatttatatcgagattgcctgcttcctttccatcttcttcctaagtatctgtgtttattctactgtgttcaggattcgtgtatttaactattattatttggcctcacatcaccagactgatgcttatagccttcttttcagtggcatgctattttgccgtttgacacctcctttatgtcttaatttcttgggtttgacccatatggattcatctatctctcacaagaatactcaaccaactgcttatacatctatggattctatatatattatcctatgttggtggtaattctctgcattgctacttattttagtttgggaacccgttgtttgaatctgctcggtttccagcagtttatgggagatgatgatatgacatcagacttagttaatgaaggaaaagaattaatcagaaaagagaagagaaaaaggcaaaggcaagaagaaggtgaaaatcgaagaagagaatggaaagaacgttatggacacaatagagaagattccactaggaacagaaatattcatactgaccccaaagagtcaaacttctcagatgttaataccaaccgttctgcattcaaatataccagggctaataacaggactgaaagggaccggatagaacttctccaagatgcagaacctttggattttaatgcagaaacattcactgatgatcctcttgaatctgaatcaggaaggtatcagcctggtggacgatatctctcgatgtctcgcagtgacatatttaatgatgtttaaagtctgaaaaagtttgtgggaccactaaccaaggtcaacacatcagttcagtcttgatgaacatctgtgtaccctagaatttcctctatacacagtgaaaagtgtcaagataacaaaaaaggcactgagaattaattatatcttaggaataatagtttaatgtgcattgaatagagtatcacctttttcaacaagatttattacatatcatttcctaagcatctgccttagaaatacagttacagtggaaggactttaagaaagatcaacatatgttaagaacatgcagttcagtttgtttcagattaattttttttcaagagagttattttaaagattcaaggaagccataagtcatactaaataatattatatacagttttgttattgtgacttacatttttgttacttctaaaaagtatattcaacctgtatttcccaaagaaatgtaagtgaatggagacctcaaataataactgtattcataaaactcgtgtcttaaaacaaggcttacttactagacataactgaatgtaaaaagtgctttttcaaatctgtttgcaaactcgtgggggatttttgcatgtataagattaagattatacttcaagtgatgcgtgtctgtgtatttagcatgtgtactataatcaggtgatatagtattccttcagtctttgtagtaactggatttttttatgcttctggtattgctttataaaagattttcatttcag

SEQ ID NO: 78767 - DNA, 1619 bp, Homo sapiens
tggtcagagtgcacattctttagcactactcctgtcttatccctctttgcggtcttcatacagctggcagaaaaaacatataattatatttatatcgagattgcctgcttcctttccatcttcttcctaagtatctgtgtttattctactgtgttcaggattcgtgtatttaactattattatttggcctcacatcaccagactgatgcttatagccttcttttcagtggcatgctattttgccgtttgacacctcctttatgtcttaatttcttgggtttgacccatatggattcatctatctctcacaagaatactcaaccaactgcttatacatctattatgggttccatgaaagttttatcctttattgcagatggattctatatatattatcctatgttggtggtaattctctgcattgctacttattttagtttgggaacccgttgtttgaatctgctcggtttccagcagtttatgggagatgatgatatgacatcagacttagttaatgaaggaaaagaattaatcagaaaagagaagagaaaaaggcaaaggcaagaagaaggtgaaaatcgaagaagagaatggaaagaacgttatggacacaatagagaagattccactaggaacagaaatattcatactgaccccaaagagtcaaacttctcagatgttaataccaaccgttctgcattcaaatataccagggctaataacaggactgaaagggaccggatagaacttctccaagatgcagaacctttggattttaatgcagaaacattcactgatgatcctcttgaatctgaatcaggaaggtatcagcctggtggacgatatctctcgatgtctcgcagtgacatatttaatgatgtttaaagtctgaaaaagtttgtgggaccactaaccaaggtcaacacatcagttcagtcttgatgaacatctgtgtaccctagaatttcctctatacacagtgaaaagtgtcaagataacaaaaaaggcactgagaattaattatatcttaggaataatagtttaatgtgcattgaatagagtatcacctttttcaacaagatttattacatatcatttcctaagcatctgccttagaaatacagttacagtggaaggactttaagaaagatcaacatatgttaagaacatgcagttcagtttgtttcagattaattttttttcaagagagttattttaaagattcaaggaagccataagtcatactaaataatattatatacagttttgttattgtgacttacatttttgttacttctaaaaagtatattcaacctgtatttcccaaagaaatgtaagtgaatggagacctcaaataataactgtattcataaaactcgtgtcttaaaacaaggcttacttactagacataactgaatgtaaaaagtgctttttcaaatctgtttgcaaactcgtgggggatttttgcatgtataagattaagattatacttcaagtgatgcgtgtctgtgtatttagcatgtgtactataatcaggtgatatagtattccttcagtctttgtagtaactggatttttttatgcttctggtattgctttataaaagattttcatttcag

SEQ ID NO: 78768 - DNA, 237 bp, Homo sapiens
aagttttacatattatcatccttgccatgtgttatatatcctgatactttcttttctattcgattcctttgttaaaaaaaatactggttgtggcctactaaatttatttcaaaacccattggtgggtcgtaactttcatcttgaaaaccacatcctatagtgaaggtagaacttgaagagcatcaaactgaagttcttgggaactagactgattccaaatacaagaattatggctcc

SEQ ID NO: 78769 - DNA, 307 bp, Homo sapiens
agatacagtgagtcaaagaagcagtatacaaaccagtctgatcccatgcatggatgcacacctgtgtgtacaaaatattctgaaagaaaatacgctgtaacatcaactatggttatcgctgagaggtgagatcaagagtaatttttattttcttctttatgcttatctttaacacatttcacacaataatcatgtattattttatcaaggaaaacataattaaaataaatttgtgtttggtgctaggatatttggaatcttaagaaattccaggaaaccagaacaggtgaaactttattagataaag

SEQ ID NO: 78770 - DNA, 613 bp, Homo sapiens
caagaatacaatttttggggggaaattagagttactaatttaactgggtcatagagatgtattattactgtgatttctaaagaagattatgttttctttgaattgtgctcttttcagattttgagatttttaataattcactggaagtgtgacatagatgtatcaaagggagcattgctagaagggcagctagtgatttccatagaaggattaaattctaagcaccaggcaaatgctcttcattgtgtaacaactagtaagtagagaaagaaaaaatattttctatctcttttgtcatggtttatgtcgtagcttatttaaaaatttcaattagaatcttttatcatgttattccaggattgttccataattataaaatgaaatgattatgtaataagtgtctggtggtagatttacaaatgtatcatacaggaaaggtgagtagttgaatgactcttaccatagattatttattttactggtttaagttaaaattgctcagaaacaatcttatttttctcttgattttaatctactttgtcacagctaaattatattacattgagctttacctactttttttttcccaagtctaaattttggcagtagcaaa

SEQ ID NO: 78771 - DNA, 1016 bp, Homo sapiens
  misc_feature (84)..(84): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgaggtgatgctgggaagggagagaagggggaggacactttctgaggagacgggctttgtgaggagaccgcgaagtttgggcagaggggtcgggcgtcgcctaagattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggagttgcttctgcaggaagcctttttggtggcatggtcctcaagaagttcctaaaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatccttttgatgaaaagttccatcca

SEQ ID NO: 78772 - DNA, 2065 bp, Homo sapiens
  misc_feature (84)..(84): n is a, c, g, or t
  misc_feature (2057)..(2057): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78773 - DNA, 2023 bp, Homo sapiens
  misc_feature (84)..(84): n is a, c, g, or t
  misc_feature (2015)..(2015): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgattttgagatttttaataattcactggaagtgtgacatagatgtatcaaagggagcattgctagaagggcagctagtgatttccatagaaggattaaattctaagcaccaggcaaatgctcttcattgtgtaacaactaagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78774 - DNA, 2143 bp, Homo sapiens
  misc_feature (84)..(84): n is a, c, g, or t
  misc_feature (2135)..(2135): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgattttgagatttttaataattcactggaagtgtgacatagatgtatcaaagggagcattgctagaagggcagctagtgatttccatagaaggattaaattctaagcaccaggcaaatgctcttcattgtgtaacaactaagatagggtttcatcatgttggctcggctggtctcgaactcctgacctcaagcgatccacccacctcagcctcccaaagtgctgcgattacaagcatgagccaccgttcccggcctctctagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78775 - DNA, 1774 bp, Homo sapiens
  misc_feature (84)..(84): n is a, c, g, or t
  misc_feature (1766)..(1766): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78776 - DNA, 2376 bp, Homo sapiens
  misc_feature (2368)..(2368): n is a, c, g, or t
tggtccgcaaggaaatccattaggtggatataaggcccagtccagggaatctgtgttgagtgtatagttagtatccttccattcaaactcgctggtggaccaaaagctaacttccctgatagagaagatgtcactcagcctcctcttcttgtccagcttcatcctctggataatgacagtccagcacaagggccttcttgccatcattctttatagcttcaaccacgaaatggggagttgatatcaattcagggtcttcaaccttctgcccttgcgagggttcctcctcaccatcaaatgttggtgggatgctgttgttaatattgaaagtgacagtgattttttccccccagcaactttccgcactaatttagcttctgtcccattcagttccagctcccaaactccagacatcttaggaagggttttatgcttctggattttcctttcctcctgaatttcatcactcaggaaatcaatcaaagctttgtctccttcgcacgccacacccacagccggaggtgcagggcccgcgaggccgcagggggcccggccgcagaacacgcgcgcaaactgagcagcctgaagggcgggcgcacagccggggcgccggccaggagctgccggaaaggcggggcgggccccgggggtgtggaagccggcgacgcagaagcccagcatatggggcactcagcgcagcagtggcagcatggcggagaggactgcgaacatgtgcggatgcaaaggacaacccaggcctagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78777 - DNA, 1341 bp, Homo sapiens
  misc_feature (1333)..(1333): n is a, c, g, or t
ttcttaagaggaaaaaatgttaaatttgacttgtctgttttctgacagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78778 - DNA, 1790 bp, Homo sapiens
  misc_feature (1782)..(1782): n is a, c, g, or t
cactgtctaccctgaataattattgctctaaaatttctaatatttatagttagaactctagagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgaggtgaaggcgtaaagccttgttgtccctctgcatgttttactctcctctcgagtacgaatagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78779 - DNA, 1369 bp, Homo sapiens
  misc_feature (84)..(84): n is a, c, g, or t
  misc_feature (1361)..(1361): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcggatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggagttgcttctgcaggaagcctttttggtggcatggtcctcaagaagttcctaaaagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78780 - DNA, 1964 bp, Homo sapiens
  misc_feature (84)..(84): n is a, c, g, or t
  misc_feature (1956)..(1956): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagtgcttaaacagccttcccagcccacagcagcaggggtacagcagctctcacattcagtcactagcagagatgccaggtacataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78781 - DNA, 1674 bp, Homo sapiens
  misc_feature (84)..(84): n is a, c, g, or t
  misc_feature (1666)..(1666): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78782 - DNA, 474 bp, Homo sapiens
actagcttttgcagatgcacagtgaggggaggtagatatagtgataattttaccttctccctccccttaggagtctatactttgctcacaactcatctcaatgccatccttgtggagagccacagtgtagtgcaaggttccatccaattcactgtggacaaggtcttggagcaacatcaccaggctgccaaggtaataaggaattcacagcctcttttctcctattctctaagaaaaagatagcaagcatatatggcaggcagggcccaggagcccttcctcccttaatgccccttcctctcctcttctgtcacctgggtgatcttgtaacactgcatctagcctacaactcaaactttagcttagatggatcactgtaaccagcttgcttagtcttacctcctagtaggtgtgtttgggtaaatagggaaatagttaatagggaaaaatggctgataacacacctcttcctta

SEQ ID NO: 78783 - DNA, 438 bp, Homo sapiens
tatagttacttttagaagaggaaataccgttttaattcatttgtgctcttgagattgtgtatgtgtggtaggtgtttttgttgtattattacaggttgatgaaaagcccagaaccttgatgacagattgtctggttataaagcattttttacgtaaaatcatcatggtgcaccctaaggtaagctgttcctttgtacaataatgattctcttatttaagtcattgttttccagagacctttactgtgtaggacatggacagatgtgattggttctttttctttcaatgaagatgattaaaacgtttaatatttgaggtcatggtggctcatacctgtaatcccaacattttgggaggccgaggcgggaggatcgcttgagtccaggagtttaagaccagccaaggcaacatggtgagactctgtctctacaaaaaaaa

SEQ ID NO: 78784 - DNA, 1061 bp, Homo sapiens
  misc_feature (84)..(84): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgagagacctttactgtgtaggacatggacagatgtgattggttctttttctttcaatgaagatgattaaaacgtttaatatttgaggtcatggtggctcatacctgtaatcccaacattttgggaggccgaggcgggaggatcgcttgagtccaggagtttaagaccagccaaggcaacatggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagaggtatatcctccctctttctgcacaggaa

SEQ ID NO: 78785 - DNA, 1884 bp, Homo sapiens
  misc_feature (84)..(84): n is a, c, g, or t
  misc_feature (1876)..(1876): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78786 - DNA, 1705 bp, Homo sapiens
  misc_feature (1697)..(1697): n is a, c, g, or t
agggcatattcaatttgaaaataaaaagcctctagagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78787 - DNA, 2256 bp, Homo sapiens
  misc_feature (84)..(84): n is a, c, g, or t
  misc_feature (2248)..(2248): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagttccagctcccaaactccagacatcttaggaagggttttatgcttctggattttcctttcctcctgaatttcatcactcaggaaatcaatcaaagctttgtctccttcgcacgccacacccacagccggaggtgcagggcccgcgaggccgcagggggcccggccgcagaacacgcgcgcaaactgagcagcctgaagggcgggcgcacagccggggcgccggccaggagctgccggaaaggcggggcgggccccgggggtgtggaagccggcgacgcagaagcccagcatatggggcactcagcgcagcagtggcagcatggcggagaggactgcgaacatgtgcggatgcaaaggacaacccaggcctagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78788 - DNA, 1759 bp, Homo sapiens
  misc_feature (1751)..(1751): n is a, c, g, or t
tgacattatgggttttactctgatctttattctcgtgtcttctgaagttccgtgtaatagatactctaacccaagaagtgatggctatttagattttcttttgcatacaattctcattcccaaagatgtctccctttggttgtccaaaaagctttctgaggtatagttacttttagaagaggaaataccgttttaattcatttgtgctcttgagattgtgtatgtgtggtaggtgtttttgttgtattattacaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78789 - DNA, 2018 bp, Homo sapiens
  misc_feature (84)..(84): n is a, c, g, or t
  misc_feature (511)..(511): n is a, c, g, or t
  misc_feature (520)..(520): n is a, c, g, or t
  misc_feature (532)..(532): n is a, c, g, or t
  misc_feature (540)..(540): n is a, c, g, or t
  misc_feature (552)..(552): n is a, c, g, or t
  misc_feature (2010)..(2010): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgattttgagatttttaataattcactggaagtgtgacatagatgtatcaaagggagcattgctagaagggcagctagtgatttccatagaaggattaaattctaagcaccaggcaaatgctcttcattgtgtaacaactagatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatggtgttncttcttcangaagcctttttngtggcatngtcctcaagaanttcctaaaaaatacagtccatactgcccggaatctctgcaaagctgacttggacttcagaggaaggcagctattctcaggatatgacaggggtaacacccttccagatgatttttgaggtcagatttcatttcagtgtaaaggtaaatggaatcctctccacagagatctttggagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtnaaaaaaaa

SEQ ID NO: 78790 - DNA, 1526 bp, Homo sapiens
  misc_feature (84)..(84): n is a, c, g, or t
  misc_feature (1505)..(1505): n is a, c, g, or t
gcaggctgtactccccgggatttatgggatggaagggatgggctcgcgctgccgggcgtgggcgtggctcgggcgtgggcactngcggagttccaagcccgggctgaggagggggcggcggcggcggcggcggcggcggcgggcgggtacccttcgactgggcgttgccgctgttccctgcgcggcatggaggggacggccgtggccgtgttcgagttgcttctgcaggaagcctttttggtggcatggtcctcaagaagttcctaaaagaaatacagtccatactgcccggaatctctgcaaagctgacttggacttcagaggaaggcagctattctcaggatatgacaggggtaacacccttccagatgatttttgaggttgatgaaaagcccagaaccttgatgacagattgtctggttataaagcattttttacgtaaaatcatcatggtgcaccctaaggtcagatttcatttcagtgtaaaggtaaatggaatcctctccacagagatctttggggtggagaatgaacccactttgaaccttgggaatggaattgctcttttggtcgactcccagcattatgtgagagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatttctatatggacctttgggtctgcctctgatattgtcaacttgggagcagccgatgactactttcttcaaagatacctcttctttagttgactggaaaaaataccatttgtgtatgatacccaatttggatctcaatttggatagagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggagtctatactttgctcacaactcatctcaatgccatccttgtggagagccacagtgtagtgcaaggttccatccaattcactgtggacaaggtcttggagcaacatcaccaggctgccaaggctcagcagaaactacaggcctcactctcagtggctgtgaactccatcatgagtattctgactggaagcactaggagcagcttccgaaagatgtgtctccagacccttcaagcagctgacacacaagagttcaggaccaaactgcacaaagtatttcgtgagatcacccaacaccaatttcttcaccactgctcatgtgaggtgaagcagcagctaaccctagaaaaaaaggactcagcccagggcactgaggacgcacctgataacagcagcctggagctcctagcagataccacgncccgggggggggggggcccca

SEQ ID NO: 78791 - DNA, 277 bp, Homo sapiens
taaaaacatgggttgtcacttaagtttggagtgcagtggcatgatcatcagtgagcgtgagatcactgtaacctcaaattctaggctgaagtaatctttctgcctcagtctcctgagtatctaggactacaggcccgcacaacaatatctggctaatttttaaattattctgtagatacaggggtcatgctacgttttctagtctggtcttgaactgctggcctcaagcgatccattctcaccttggcctcccaaagtgctgggattacaggcatga

SEQ ID NO: 78792 - DNA, 405 bp, Homo sapiens
ctgcttgatgtggttcagtattataaaagctgtttatggtgaaaaagcagtagatgttttatagtaatgatgatgccatgtagagaaagtacttagattacttgagtagttttacagaaaacttttcagcatcccattcaattttctgtctttccttttaattttcttctagttcatcattcttgttgttgatagcattgacagggaacgactagctattacaaaagaagaattatacagaatgttggctcatgaggtaaatttttaaagtaaatctttaaaaaacagtgtagtaaagtatctgtacgttgcctttgcttttttgcaaagattaatgtgatatgatgttggctattttatgattaacacaactttatgtactaaactgatgaaagtcttgaggta

SEQ ID NO: 78793 - DNA, 1843 bp, Homo sapiens
  misc_feature (1810)..(1810): n is a, c, g, or t
agcggaggtgggtacagaccgaggggactacgggtcggcgttgggctcagtgggctcgaaacaaagggctgtccggtggggattcgtcgcggcgccttctgagtggtcgggtcgaggcttctcggcctagcagtgccctcgctgcgcgatctcaggcgggttctcctcggctccgcgcagcccgcgccgcggtgggggacccggcgcagcggcacctgctgccgagggaccccgcggcccgccccggtgctcgtgatggggctgatcttcgccaaactgtggagcctcttctgtaaccaagaacacaaagtaattatagtgggactggataatgcagggaaaaccaccattctttaccaattcttaatgaatgaagtggttcatacttctccaaccataggaagcaatgttgaagaaatagttgtgaagaacactcattttcttatgtgggatattggtggtcaggagtctctgcgatcatcctggaacacatattactcaaatacagagttcatcattcttgttgttgatagcattgacagggaacgactagctattacaaaagaagaattatacagaatgttggctcatgaggatttacggaaggctgcagtccttatctttgcaaataaacaggatatgaaagggtgtatgacagcagctgaaatctcgaaatacctcacccttagttcaattaaggatcatccatggcacattcaatcctgctgtgctctcacaggagaagggttatgccaaggtctagagtggatgacctcccggattggtgtgagataacttttttgcttgaaagagactgctctatttattctgtgacatgaacattttttcctagtacctttggctgctaaggcagcagcatgtttaatttataacaacacaaacctctgagagcaacacttgaatcaagtgcagctgaactggaacataaaagattttttcttaactttttttttttaacacactaatcttcagttggatgaatgtaatgtataactatgttttcagcaacaattcttctgtttattctaattaatcagtgactgccttgtaagaaatgtttgtcatatgcgtgatgtcttctgaaatattcttataaccttaatgaccaattgctttcaattcttgaccagcactccctcccaaccagagaattactggtttgatagagtagtcttggaaaccatcaggtactgcctgcagacttctccagcactaaatatatttgttccctctataaaccattcatctttcggacagaacttactgtaaagaaagaaatctgcctagaggatatatgtaaggaagattccacatcatgagtacttgccttttaactttcccccacattactgttgagtcatggaataatgtttaagttgttatttgcatggaaattaagtaggctgtttatttatctaaaggaatcaagtccactcttctgcctgcaacatttgttcaaaaactaaccgaggtaaaatatttatttgaaagcccaactttgatgttaaatattcttgaataaatctgttattttaagaatatcacattattcaatgcatataaaactatcagaagttagtaaatcataccagcactaaaaataagacaattggaatatattttagcatcagtttacaaacaactttattatcaacagaaattttagctcttttctttgcaagatatatcacagctgctttgggcagtagctgaagccgaagtatgaacagtccattttgtttcttaaaatttgaagtcgtgtctgtcatagcatttttactaccagcantatgttacttaaaaaactacatggctttccttg

SEQ ID NO: 78794 - DNA, 289 bp, Homo sapiens
ttagtgtcattgggttggtgtcggccttgaacttggcaagtagctctacatacagaatgctgggtgccccacagccccacctgctgggaaacccatgtcagagctctgcgttcctctcctcacagctcagcgctcccattagcatttttcagccatcctggggactgtggcctctgtctgccttccttggatacacactcaattttaaacgcactcagagccaagagccacggctatagtttgagagtgcttgagagtgcgtgtcccacctggggtgcttggcttggtc

SEQ ID NO: 78795 - DNA, 601 bp, Homo sapiens
tgttattatcataacttataattatccttttacccatgtttatttgtgtggtttctatctctccctttacactgtgaaatctatggagatatgggtcatgacaatttattactgtatgcttcctgtccagcaaagatcctgcaactaatattcaataattatttgctgaatcgaaaatatatggaggaaacaatgaatgaccaatagctatcactgttattatggtcattgtcagtatcagaaaacaagttctcatttgataatgagagagttaaggacagaacaaagaatgcaccatttaacaatgcttgaaatgaagtcagaggtagttactagaaagggggagcatcaggtagttgccatttagttgtgaatccccagtgaaaaatttaatgcaatagaaggtgctgatatttctcattatctaccttgcatatatacacaaatgttttccttgattttgctaataatgagcgccctctgctgtctttaatctgcctcaatagcctgcgagctcttcatctggttgctttctaaaataaaaaataatgtagcaaataaattgtacttacctgtctggttgtactgcctatcttagaca

SEQ ID NO: 78796 - DNA, 297 bp, Homo sapiens
catggcccgctctagaggatccactcgcgttttgatggggagcatcaggtagttgccatttagttgtgaatccccagtgaaaaatttaatgcaatagaaggtgctgatatttctcattatctaccttgcatatatacacaaatgttttccttgattttgctaataatgagcgccctctgctgtctttaatctgcctcaatagcctgcgagctcttcatctggttgctttctaaaataaaaaataatgtagcaaataaattgtacttacctgtctggttgtactgcctatcttagaca

SEQ ID NO: 78797 - DNA, 470 bp, Homo sapiens
tgcctcccaaacccggttccaaatggcactccaccgcccgtggactgtgctggctgaagttggattttcctccttaaagtcaccaggatcaggagccctgattctgatgaatagaagctatgtttgggacgagtggtcactggctcacaggacgactctgattttagagggacggaacgaggacaggacgattgtgattttagaggggctgaacaagtacttattagcttagtgcagaaataaaagaacacaactatcccccctaatagtcaaccaccggtgactgcagcccctgaggatggccgcctgacagcttgggagcgcctcgggagtgctgtgcaacgtggagaagagcatcacacgtgtaatttgtgttccgcgattgaaatgggcagagaagcaacacgttagggtgcaggaacctctccccgtgtgcccccacccccagaatttggctgcagctcccatgc

SEQ ID NO: 78798 - DNA, 265 bp, Homo sapiens
gagtgcagtggtgcagtcttggctcactgcaacctccgcctcctgggttcaagcgattctcctgcttcaggctcccaggtagctgggactacacacagggtttcactgttttagtcagcctgatcttgaacttctgacctcaagtgatccgcccacctcagcctcccaaaatgctgggataacaggcatgagccactgctcccggcctagaaagataatttataaagaaacactaaattatggagttagcctaatcctctatttt

SEQ ID NO: 78799 - DNA, 435 bp, Homo sapiens
catcccccacagccattactcttctgacttctatcagtagaggttaaaactcaagtctcttttgagtaagtctttaatttaggctcattcctctcccttgttttcttcttctctggggacgatctaattttcaggggccttattaccatcctgccatcaggggagagttcttcttcaagaatgactgattctttaatctgtgtatacgcaataaaccatcccaaaccagagtgactaaatccaagacattattctctcatattttgttggttgactggattcagtggttcggcttatcctgcttgagctgtcttatgcagctgtgggcagatggcagctaaagccggatcctctggaggacagcactgggctggaaggcctgagttgcctgccttcttcactctgagaaaataaaaatgagcttgggctaagaat

SEQ ID NO: 78800 - DNA, 168 bp, Homo sapiens
cacctgcctcggcctcccaaagtgctgggattacaggtgtgagccaccacgcccggcctcattactattttaatttggattttaaaacattttaattgcagtaagacatgtaatataaaatttaccatcttcaccatttttaagtgtatagttcagtagtgttaagtc

SEQ ID NO: 78801 - DNA, 600 bp, Homo sapiens
gcaggccttctggaaacacctggctggaaagggccttggccaccagtgacctgtaagggggagatgaggttggtgagggagctgtgggcatcaccagtggcagccagatgcttgtccatcaacagctcccatcctgctgctcctcctacccacctatgcaccaggcatggccccaagaaagcgcctggcagcacagagtggttgggtgaatttctatactccctattgacttgggtcttggattaccgtctacctcaaggtcgaggaaggcaggggcatttattcatttttttgtcttcagcgcctagaacagtgactggcacgtagcgggcgcacagcaaatatataccaagtgtgcgagtgaatgactattctaggtttccagaggcaggggttgggaggaagtggcccctgttgagaagcccgggaagcccatctccagctgtctgtttccctttaagtcgaatcaagagcaacgtggatgggcggtacctggtggacggcgtccctttcagctgctgcaatcctagctcgccacggccctgcatccagtatcagatcaccaacaactcagcacactacagttacgaccaccagacg

SEQ ID NO: 78802 - DNA, 2992 bp, Homo sapiens
gaattcttcagcgcccaggaccaggactatcccctgctcaagctgtgattccgagacccctgccaccactactgcattcacggggatcccaggctagtgggactcgacatgggtagcccccagggcagctccctacagcttgggccatctgcacttttcccaaggccctaagtctccgcctctgggctcgttaaggtttggggtgggagctgtgctgtgggaagcaacccggactacacttggcaagcatggcgctactgaaagtcaagtttgaccagaagaagcgggtcaagttggcccaagggctctggctcatgaactggttctccgtgttggctggcatcatcatcttcagcctaggactgttcctgaagattgaactccgaaagaggagcgatgtgatgaataattctgagagccattttgtgcccaactcattgatagggatgggggtgctatcctgtgtcttcaactcgctggctgggaagatctgctacgacgccctggacccagccaagtatgccagatggaagccctggctgaagccgtacctggctatctgtgtcctcttcaacatcatcctcttccttgtggctctctgctgctttctgcttcggggctcgctggagaacaccctgggccaagggctcaagaacggcatgaagtactaccgggacacagacacccctggcaggtgtttcatgaagaagaccatcgacatgctgcagatcgagttcaaatgctgcggcaacaacggttttcgggactggtttgagattcagtggatcagcaatcgctacctggacttttcctccaaagaagtcaaagatcgaatcaagagcaacgtggatgggcggtacctggtggacggcgtccctttcagctgctgcaatcctagctcgccacggccctgcatccagtatcagatcaccaacaactcagcacactacagttacgaccaccagacggaggagctcaacctgtgggtgcgtggctgcagggctgccctgctgagctactacagcagcctcatgaactccatgggtgtcgtcacgctcctcatttggctcttcgaggtgaccattacaattgggctgcgctacctacagacgtcgctggatggtgtgtccaaccccgaggaatctgagagcgagagcgagggctggctgctggagaagagcgtgccggagacctggaaggcctttctggagagtgtgaagaagctgggcaagggcaaccaggtggaagccgagggcgcaggcgcaggccaggccccagaggctggctgagggccctggggcccctcccctcccgaacactgagaaatagtgcactccaagaaacgtggatctccccctcatccaactccgaaagtctgaatctcccaaggagggcaccatcttacagagactctccctgacggtggaatttaagtttagggtccctaaaagcatttgacacacagttgttgaatgactgacccaaaatgtgaatgaagctaatgtgaatgtgagtgaagctcccttcaggcccgctgccctaggatatgccctcctggtgactcgggggctgtctcagacgactagcccaggacccatctttctcacacggatttagtcccaccctatggccactggccgtatctgagggctgctccccttttagaatttacctcttatgagctccatgttgcttcactctatccaaagtgtcacttggtgcataagcacagaaatctgaaaaatggccatgttgtctttttttttttttttttttaatgccaagattgacaggttggccgtttgcttaatgccagaagttgggggaaagttacacttttctaagaataatggactcttaaggcattgagggctctaaacaggattctttaatcatggagcaagagaatttcaaggcaggggattttatcccccaccaaaaacacagtgaaaggcctgcttttgtgtcccattcacatgccctcggtcactgagtctggagtgaaccacgggttgaggaagtcaggctgttggcgtgtcccagcaccacaccatccctaaagtgccaggtgatctcctgtggctcatcggtggaagcagtggggtaggctgctgccctgctgtggaagaggagcaacaatcagacatgagtccaccctttggagaccaggcctcagctcttggtgggcccagggacacccacacaggtggccatcacagccccatggacaacactaattgtccacagcaaagggcaaggaatcctctgggagcttcttccgtttcttcccccaagatacccatcttgaaaaacactatttctggaatgcttctgcatcaaaggagattctttgagatagcccatcttcctgagctagcaaatacaggagttttcactttctttaggaaagagaagctttcaggggaaggagagaatgattttgctgacttcccaagccctggtgaccagaccaaggcagggcccagcataattcctccagttggatgaacattcaagagagctcgttcctacctggctggagaccgaggccagaaggcaaaaaccagaaagggaacagtccataacttacctctgcttctgaccgatggtgtttgggaataggttactttggactgagtttgggttctttgctgtcctaagaactttagtgtagagaaaataagacttctggtgctgctggggtatgttctgggcttaattcccccaagcagaagaccagatccaagatgtttggacaccctgtcagacgttggtcccaagtttaattagatttctgaatctcgttgaggccaaggaatgatccatactgaaaaaatgctgagccagccatctttggcaaaggtccctgagctcttgctatctctcaagagtgctgagaaccacggtgaaagtgctgctctaggcccacaagtgtaactatgctgttaacagctgtcaatagataattaaaattcatactgtatgaaaatca

SEQ ID NO: 78803 - DNA, 848 bp, Homo sapiens
caagatttctgaacaaagcaggggtgtgaagcagattgatgcaggtgctaggtgccctcctgcgtccctgagcctgtttctggccaaagctcacagagtacactgaaaacaaatggcacagctcacccatcacgtctgcttcccactaacaagcaagagtgccatgggatgaggtctcctaggccatgggcagaggcccctcaggggttcccaccatgcatggtcccctggagaagagcctgcaaggtggccgcgcccctgccctggctctcccagcccctgggctttgctgttctgcccactccaggacactgaggcctgctggagaggggggtaaaccctacctggggcaggcctcggggaagcctggcctcaggcttctcatgttgattgattcagagcaagtcaaatgcagcaggctcatccttgcttcagcttcaggtaggcctctttcttttccttttttgcaagaaatagattagatcccagtttgggtgcggatagcttgcgcctgtactcccaaaatgttgggattacaggcgtgaaacaccgcatccagctggaagttctttcctctaaatatctgcatggctcaccccctcaccaccttcaagtcgacacagctgtcagtcctcaatgagacctatcctgaccaccctttaaaatcttgcaacctccagcactcctactcctgtttgctatgtatttttctgtcaattacttatcaccatgagacttactacacatttttcttgtgtctttcctctttgtttcctctcttagaatttaagctcccctggggcaaaaatgtcagtctgtttgttcacgattgcatctccaggtgccca

SEQ ID NO: 78804 - DNA, 662 bp, Homo sapiens
agaccatcctggacaacatggtgaaaccccatctctactaaaaatacaaaaattagctgggcgcagtggtgcatgtctgtaatcccagctactcgggaggctgaggcaggagaattgcttgaaaaagggagtcggaggttgcaatgggccgagagatcatgccactgcactccagcctggcgacagagcgagactccatctcaaaaaaaatagataaataaaataaaataacaggtcctgatttgccgtgttgaccaatttctgtggtgtaaatacttccacagtgggaagaggcgcacacaggcagctgtcatgagctcttgtgagctaggaggggctggtcttgggctggatcttggcaggtcgcttaatcgctctagcctccagagactgagcaaaaggcaggtacctccctcaaaggttgttaggcagattaataacaaaacatggtaaagcagttagtgccgaacctagcactgtggtagacgtttgctaaatggcttgatttactagttgagattccattaggtaaagtcctaatgtcttatgcctcaaatgttttaatcttaaaaatagtcataaaatactttccccacctcttgctcaggataattggaatgattgagtgagatcatctgcatcaactgctttggaagtccaca

SEQ ID NO: 78805 - DNA, 692 bp, Homo sapiens
ttgtggaaatgttgaagcaaggctgtgccattactcaggtggagatctttggagaaggccacatagctagccgcctccacagggagacctaacaggtggcttagaccttgaataaagaaggaactgctttgtcgtgtagcaattttaaaaaagaaagaaaaaaataaggaggaaacatttagcaaactattttttgttgttgtagagacggggtttcaacatattgcccaggcgggtagtgaattcatgagctcaagtgatgcacctgcctcagcctcccaaagtgctgggattacaggcatgagtcactgctcccagccccaaactattttttttttaatttctcatgtgacatgtaggatagcctagggaaccctgctactcatcctctatcaccagaagccctgcttttttctctttgtctttcttagcatttgtgctgagtgatatggcccactctgtgattaaagtattgtgtttagtattacctttagcccaatacgcacaggtccctggctggttccttgggtgaagtgtgagaagcagcttgtctttttctctcacaatagtcatcttgagctttagggattttaacaaaggtctagctttaacagcagagtagagatagcgtatttacaagtgggtggatttccaggagaagttgatagtatagttgttatcagatgtgagaa

SEQ ID NO: 78806 - DNA, 479 bp, Homo sapiens
ttgattttgttcaaagatatctggggattggattggggaatgcttaatctgactattgaaagaaacatggatccctggagtatttcagatacggggttaccgccccagactgcctcccgccagtccacattagttctcattttccctcatgatggtgaaaaacagtggagagctagtaaagggtttatgcagaaaacaaggagaagagaatgtgaagtttgaagtgcctatggaacatccagctgataatcttgcctagtaagagcaaaagaagccaagagaacaccaacgtttaaggagcaggtagagaaaacccagcaaaaggacagaggaataagaggaccaaagaacaatgttaagaatcaaggagagaggtcaggcacgctggctcatgcctgtaatcccagcactttgggaggctgaggcaggtggatcacttgaggccaggagtatgagaccagcctgggcaatgtggtgaa

SEQ ID NO: 78807 - DNA, 198 bp, Homo sapiens
tttatattgttattttatatttagaggcagggtctctctctgtccaggctgaagtacagtggtgtgctctctgctcactgcagacttggcctcccaggttcacgcaattctcccaaagtgctgggattacaggcataagctgctgcgcctggcctaactacgtcatttttaaagtctatttaaaaatgtgtagtgaaa

SEQ ID NO: 78808 - DNA, 653 bp, Homo sapiens
tttttttatttttagtagagacgaggtttcactgtgttagacaggatggtctcgatctcctgacctcgtgatccacccacctcggtctcccaaagtgctgggattacaggcgtgacaccacgcccggcctaaaaattaatttttaaataataaatacttacaagaattgatagttttctctttctttttcttagtagtcctttttttttcttttattgcctaactcaatttaaacagcaaattttacttgtaacattccatgtctttcttagaataacaaattgattttgctgtctcatttgattcatattcttgttttcatttctgcacataatacccagcctaatctcagtattcagtggccttcctttatgttttaacttttgaaactactcaactcattagggctcaatttttagtcaattgttgtattttggcaactggcagaggatgtgattaaccagcattttgttttcctcttgcttatttcctttttcattttatgtaacgatttagtaaccattaggtaagttaatttgtacttttcttaaaaaaaaaactttcacaaaggcgtcctttctttctccctctttttaatatatacgagacccatcttaaaagggtgtacgttctgaatctgagtagggaatctc

SEQ ID NO: 78809 - DNA, 1001 bp, Homo sapiens
acaaagacttctacggacgcattcagaaccttgtgatgattacaaatctgagaaacacattgactttgcccaaaggtaagagcacaaaatgaagcaaattcctgactcctttggcagtgatctaatggttagattactaaatacggcatctttttttttttttaaggaatgtcactattactcatggagagaaacacatttctacagaatttttacaaactaaaaagaaattctaattaaaaacaattatctaacagtttttcctagcaccgaacatagtacttggtacatagaagatactgactaaatgtttgttgaatgagtgaatgaataaagggaaaaaaatcacatgtaatttgaagacacaagagaaaaatagtttgctcaggacataatgtagataaggcttactgtgtccagaatgtatttttgttttgttttgagataaggccttgctgtgttgctcagattagagtacagtggcaggatcagcttgctataaccacagactcctgggctccagggatcctcctgcttcagcctcccgagagtagctgggaatacagacatgcaccaccttgctcagcacattttttaactttttgtagagatactgtcttgctttgttacccagactggtctcaaaccagggtatgattcctcttcataacttttattgcaagacctgggataatttggttaattaaaaatttttctaaaatgaggatactgttcacctagcgagcatgtgatgaaagtaatattacaagatattctaggattcttagatgaattttattttttttactatctataaaaatttattgacatctactttctatttactgaattataatagtgtgtgtgtgtttcagtgttttaaaatggtctaccttcaaaagaaaaggtaccataaagtttttcaggttgtccaaattttgtatgtaaatcaagaacttctaaaagattagccatacaaaatggaggaagttaaaaaaaat

SEQ ID NO: 78810 - DNA, 335 bp, Homo sapiens
tgtttcaagcaagggacagacagactgtattgcaagctactgagatggaagacaatggacacagaacacaggtggcctttatcccaggtcagccacaatctaagccccacaggactctgcacatccttgattctgaccctatctcccacccatcctgtgttccagaaaccaccaccagcaccaaccgccctgtcattagactcttcttctccaagcatacttctagctgcactctcatgaaaacctggcttcccctggagctttcgggtgtagagatatcttttcgcaggatccctctacctctgggtctgtaggtggggttggggccctcctgg

SEQ ID NO: 78811 - DNA, 352 bp, Homo sapiens
tcaaaaactcagtgtcatagtattggcttgtagtgcattgggcagcaagccccttttgcttgataacattaggaccatgcctacctagccctatcacataccaggctttgtgatcctagataagtaatcacctctctaagcctctctttatctcaatgtaaaataagcaagttgaaacctttcggccaggggcagtggctcacacctgtaatctcagaagtttgggaggccgaggtgggcggattgcttgaggtcaggagtttgagacatccttctgctttggcctcccaaagtgctgcaattacaggtcactgcacccagcctatttttcattcttctcactaaagtctaa

SEQ ID NO: 78812 - DNA, 450 bp, Homo sapiens
attcctcccccgacccccgtttccccccgtaaagaatagccatgcgttattatttcaatgtgccccccaacgtttaagtgttataaacttaatccccagggtaacagcgttgggagatggacctttaagagatgattaggtcacgggggctctgccctcaagaatgcattaatgctgttatcagagaagtggcttcctgattttaaaacaaggatgaatttggccaggcccctttcctcctcactcttgccagggatgccccaacaagaaggccctcaccagatacagccccttgaccttggacttcccaacccccagaactgtaaaaaatcaatctctgttctttataaattacccaggctcaggtattctgttatagctatagcagcacaaaacgaactaagacaccatgtaaattacacttttcatacctcacctgattaacgattc

SEQ ID NO: 78813 - DNA, 650 bp, Homo sapiens
agttctgtgaactttatacatatgtataggttcgtgtagctaccaccgtcaggatacagaacaaacagttccctcaccaccaaaacctccctcatggtattcctttatagtcccatcttatttcaaggcaactcactaatcctgttctcaatcaccataattttgattaaaattatttttagtatacatattgattacatttccagtggacttgaattaattatatagtcttgatttgtaggttggcttaaactaaacagtttgtaaagaagaatatctggcttatttgatttgtataacttttttatggaaatactgaactgtatctgaagttttccatttccccagaacacaagtaaatacgttagaagttttagttaacccccccctttttttttttttgcatttatggtttaatattctgaatagataatagtcaaatgggtcaaaagtataacatataacagttgtaattttttggatttttactagctcggagtgtatatatgtgaattatttcagtaaaatacagattaccttctaaaacatataccagtttatactccacgtaatatgagagtgctcccttagtcttgccaacacaatgttgccaacagtgtgtatgtatacatatatatttttacatatgt

SEQ ID NO: 78814 - DNA, 569 bp, Homo sapiens
tgtccccatcactgatctcagcctttgctagtcatcagatgccaccaaatgaaaaagaagcaactcagagttggaagatgtgctgtgccccagctccgcagagccccacacccattcaaaactccctcaacaggtagctgtctgccatggatttatttcagctcttgcagaagacgttagtatttccaaactgtcgcttctaaaggaataagggacccaaattccctgactagcatgtcaaacaaaatttcctggtttttttcttctaaattcaccaacttttctatttgggctttcaggaatgcctcctccatctagcaatactgactctgagtcaagttcattttcagtgcacccagcccttctgctaattctcatttcgacttcaagctcttctgagcttccatcttttcagatgaagcgcacttgtttatggctgcacagatcccttccaagcccttctgatctctgtatctttgcagttactttctctggttcatttccatcttggtatttgccgaggccgtctgccttgagaaagtgatctcggctgtatttatgaggtgtcc

SEQ ID NO: 78815 - DNA, 536 bp, Homo sapiens
tcagactgtgccttgaaatatattaaagaacaaagcccctagtaatgctcattcctaagccaatcaaaggctctaaaataaaaagtttgttctttctagttttagtgttgtgttgaatttttaggcaatttttcaggtaagctttctaagagaaagagagctggggtgggcatctgtcattctcaggtccccaaatgtgtgggagagggctgtttttcttcctgttacagagtaattttaaagaaatgcagttgtttctgaaaccagcctctagttccatgtcacgaagaccttcagccactgtggttaagaaaatggttagtttgcctgtgtggtctgttgtcctctttcagagtctgcttatattttcctgtttcccacattcttgtttcctaccctcggctacactaatgtatcattttcttgtgttagatctctttactatagcaactaacagtctattatccataattccaaagtccaagaactctgaaaatgaaacccatttggtggcgaaactgccctctcctgatctg

SEQ ID NO: 78816 - DNA, 254 bp, Homo sapiens
gttcaatagtaaaattgttagtcttcaataaattacgcctgtatattttattattggaggagaagggaagggaggagaagggaaaggaatggaaaggaaggaaaggaagggaagggaggaagaaaggaaaacacaagaaaagttctacctccaagtagaatataaatgtgagaaacaaaacttttaaaagaaaaaatagaagaatatatttgtgatgttcaggtagtagcagattcttacataaaatataaagt

SEQ ID NO: 78817 - DNA, 754 bp, Homo sapiens
ggcgggcgcgtggctcacgcctgtaatcccagctctcagggaggctaagaggcgggaggatagcttgagccctggaggtcaagaatacagtgagccatagccatagtcactaggattgtacgtatgagccaccgcatccagcctcaatggcaatctcttaaaaatctaaataaatgaacggctcagtaacactgaggtttacttcacacaaaaacaatccaaaccttggcaagacggtgaaaccctgtctctacaaaaaatacaaaaaattaactgggcaaagtagcctgcacctatagtcccagctacttgggaggctgaggtgggaggatcgattgagccctggaggtcaagaatacagtgagccatagccatgattgtacactgtgccactccagcctgggtgacagagcaagaccctgtccccctctcaaaaaaaaaaaaaaaagaaagaaaaaatttgggggccagcactggaccctagagagaaggattttcaacaagcccctctgtttgtgggcggccgcaggacccaggatagtgttagtgacgacagtggccaatcacgttgcccccaaaaagaacccgctgggcgctaagcaattgttgcgtttgggttttcctcccaaataagaaaagcgcgcggcggacacccggcgtgtttgaaccaactccaagatgggtctgacggccatcgggcctactacagggggtcccagcgaggtagatatatcgaccgacacagtgaggggga

SEQ ID NO: 78818 - DNA, 1788 bp, Homo sapiens
aaatgagggagcttatttggatgatctttaaggtctcttttggcactaataactcggtgtctcttttttttcaccttcaccatttcagttgatccaccaaacaaacctgagagatcaggattggcatccaagagttgtctcggccaactctgatgtcatgcttactctgtactagacattgttccaagcattttacgtgcattaactcatttatcttcccaacatcttgtgagggaggcactatagtgagcctcatttgaagatgaggaaacaaaggtacaaagaggttctagctggacctctaaagtcacataataagtaagtggtagagctggagttcacatccaggcagtaggctccaaggtctgtgctcttaaccacattctgggctgcatcttttatagacaaactatgatccagagagattacgagacttggatcacataccaagagagtgttaaagccacattaggattcaattccagggccatcagattccaagtccactggagaaaagatgtatatctctaatctgttaacaaattgctcaactactcagactaatcccaggtgatggatgtctaatgctcaggaaaggcgagtcagtctctgaggcaacagatcccatgggcctgggtagaaaatgcccagtgcttcccagtcccaagtgctggctttccctgtatctgcctctgccaggcaacacttatcaggctcccaatcagcaggagcctccatgctccactttgaacagcctctatgctccagcaatggggcatttgtgaagagtgacttgattaacttttctgaccatgggtataatacagttgcttcagagggcagtggttctgggtgtgatttttacactgtaacattgtatacagtgtcatggataattactatttttttctggtcattaacactcacctactctagtactaggatttcagaccaaggtcctcatgacgcctggatattttagtatctatatccaataatcttttctctcctactgaatatccagggcaaagatgaaatcgttttctttaaaactgtcaaattctgtaaaactcaggagccagttcaagggaacaagcatcttcacaatagatggaatcaagagttaaatgttatagtgagtcactaggattgtacgtatgagccaccgcatccagcctcaatggcaatctcttaaaaatctaaataaatgaacggctcagtaacactgaggtttacttcacacaaaaacaatccaaaccttggcaagacggtgaaaccctgtctctacaaaaaatacaaaaaattaactgggcaaagtagcctgcacctatagtcccagctacttgggaggctgaggtgggaggatcgattgagccctggaggtcaagaatacagtgagccatagccatgattgtacactgtgccactccagcctgggtgacagagcaagaccctgtccccctctcaaaaaaaaaaaaaaaagaaagaaaaaatttgggggccagcactggaccctagagagaaggattttcaacaagcccctctgtttgtgggcggccgcaggacccaggatagtgttagtgacgacagtggccaatcacgttgcccccaaaaagaacccgctgggcgctaagcaattgttgcgtttgggttttcctcccaaataagaaaagcgcgcggcggacacccggcgtgtttgaaccaactccaagatgggtctgacggccatcgggcctactacagggggtcccagcgaggtagatatatcgaccgacacagtgaggggga

SEQ ID NO: 78819 - DNA, 248 bp, Homo sapiens
gcaaagatgaaatcgttttctttaaaactgtcaaattctgtaaaactcaggagccagttcaagggaacaagcatcttcacaatagatggaatcaagagttaaatgttatagtggcaagcttgtctactgggcaacagacaaccagacctgcttgtgagatggcagctccccagccctgctctgtgacctcatttctgtcaaatgaaaggcagcagcttccagctgattgcagcatagtgttcatcaat

SEQ ID NO: 78820 - DNA, 418 bp, Homo sapiens
gtgacttctgttcaacactatggaagtcctggacagtataataaaccaataaaaagcaagacaagacattaagattcgaaagaaagaagtaaaatgatagtcacaggaaacataattgcaaatttcttagttttctatataaacaaaccactagaagtaataagtgaaacagacttatcagactataaagtcactatacaaaaatcaattgtatatctacatactgacagcaaacaactggaaagtcaaattcaaaagttctactgacagtaatgtaaaattataaaatacttaagaataaatttttaaacaggcatgcaagactgctacattgaaaattatgaaatattgaggcccaatattaagatgttgattctcccccaaatgatctggactcaatacaattctctgagaaaat

SEQ ID NO: 78821 - DNA, 2903 bp, Homo sapiens
tgggtcggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagtagagatggggttttgccatgttggccagaatggttttgaactcctgacctcaagttatctacctgcctcagcctcccaaagtgccgagattatagccgtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggtttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaaaaaacatctcat

SEQ ID NO: 78822 - DNA, 2966 bp, Homo sapiens
tgggtcggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggtttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaaaaaacatctcat

SEQ ID NO: 78823 - DNA, 3133 bp, Homo sapiens
cggccgccttgtgtgtgccaggagagtggcagtgccatgctgctgggagctgccccggagagcagcccaggaccccggcggggccgcccctcgtcctctctcgtccccgaggggtcgggcaggaaggaaaatcaaactttattcccctctgtgacttcctctgtgtgtgtgcatggggaaccggctccctcgagatggatgctgcattgcttcaggaggcaagcttcatcctcttgggtccttaaaggtgcttttgggggtcctttcgagggctactgtataagcgtgttcacgcgtgcctgaagcgggaagggtggtcagcaggcacaggagaagcgaatatggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggtttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgtcaaaacattttctaccatatttccagatgacatctgcgcttgaagagtcaaaggaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaaaaaacatctcat

SEQ ID NO: 78824 - DNA, 2911 bp, Homo sapiens
tgggtcggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggtttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatttatctttatataggaatacatttctagggcttccttcaagcccactctcttcaccctattttttcttatcttaaattgagagaaagagaattaatcttatactttgaatctgtgtctaatatcctgtttttaactgctgtaggggcaggatggaaaggatgatgggggctgccacaccactgattggccttttctttcacgtgattcatccttcctcattgtggcaaggagtttctttctctttttcttcctcctttgggatcattgtgtatgaaaagaaaaactttaaatgacaaacccagactccaggtgccttgcaaaggttgaaggccagccaggattgctgctgctgctgctactcctgccaacacccctttcattggcatgacggaatgaaaggatgcatgtctccacttcctgaccctccgcccacttccttctccctccaccacccccagtcgtcagctccttccctcatttatttttgttaagttgtgtgaattatttttaacccatttatcctgtttgtgcatagggtttttaagaagaaacagcacagtgcaacgagcaaatctttttggggtgtgtgggaagcaagggagggaggacatggagaaaagttctttaaacaaatagcaaactattgaacatgtgtaaaatcctgtatcatttatgaaatatgtataaaaagcaatgtaccttctggaacaataaatacttattcaatttttgaaaaaacatctcat

SEQ ID NO: 78825 - DNA, 4151 bp, Homo sapiens
ttacagcctgcttctgtgctgttccttcttgcctctaacttgtaaacaagacgtactaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcattcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtacgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgcttgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcaaaaaaaaa

SEQ ID NO: 78826 - DNA, 4483 bp, Homo sapiens
ttacagcctgcttctgtgctgttccttcttgcctctaacttgtaaacaagacgtactaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcattcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtacgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcaaaaaaaaa

SEQ ID NO: 78827 - DNA, 354 bp, Homo sapiens
aaaaagaaaaaaaaagaaaaattagctgggtgtggtattacatgcctgtagtctcagctacccaggaggctgaggtggaaggattgtctgagttcaggaggttgaggctatagtgagccgtgctgtgatcctgccactgcactccagcctgggtaacagagcaagactctgtctccaaaaaaaaaaaaaaaaaaaaaagaaaaggaaaggaaaagaaacaaaacacatgcagatgtagattgcgtgaccagggaaaatctcagtgaggaattgacttttgcgtaaagacctgaaggaattgaggcagctgacaatgaatgtgggtatctgcgcaaagagcattccaagccaagg

SEQ ID NO: 78828 - DNA, 301 bp, Homo sapiens
ctggtctcgaactcctgacctcaggtgatccacctgcctcgccctcccaaagttctgggattacaggcgtgagtcaccgcgccctgaacctctatcttcatatgtagaatgggaccagttaagcgcgttgctcccactgcttaaaagatcaaatagcagcccccactatctttttttttaagtattggcacccgcccacccaacacacacactacacactattgataacttcctgtgctaagccaggggtaggcaaacattttctgtaaatggccaaataataaatattttaggctttctg

SEQ ID NO: 78829 - DNA, 1405 bp, Homo sapiens
taaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttagggtatgggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaa

SEQ ID NO: 78830 - DNA, 324 bp, Homo sapiens
gacagcatgatgttctggaagccaagagaaaagaggagtttgaggataaatggtcagccatgtcaaatgttgctgagatgctgaggacagcgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatctgcaattacaa

SEQ ID NO: 78831 - DNA, 2580 bp, Homo sapiens
attccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaa

SEQ ID NO: 78832 - DNA, 2823 bp, Homo sapiens
attccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaaaaaaaaaaaaaaaaaaaaaaaaaaaaaaaaaaaaaaaacaaaacaaacaaaaaaaaaagaaagcacacacccaacgacagagaaaacaacagcacacaaacgcgacacaaaagagagaccaagcagccagcgccggccacacagcaaagaaccaagcgaagagcacacgccagacacaacgcccaacgacaagccacccacacgaaccagcggcgaggagaacaacacgacgagccacacgca

SEQ ID NO: 78833 - DNA, 2487 bp, Homo sapiens
attccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagaacctcagagtgacagagccaaaagaccagtgcctcattttgctgacatggaaaaggaaacttcgtgggggaaagagatctgcttgcagtcggccagagagacagaaccagggcagtgcgactccaagtgcatcagcataggcattgccaggagctcatgaggaatgcagactgtcaggtcccaccccagacctactcaacagaaactacttggtaagcagattcccaggtggttccaggcaccttacagtttgaaaagcactgctgcatgctatcctaccttcctggtctgtaacatctgttgctgttgagtataaagacactgtgaacattgtaaaatctgcaattacaa

SEQ ID NO: 78834 - DNA, 1028 bp, Homo sapiens
attccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtg

SEQ ID NO: 78835 - DNA, 387 bp, Homo sapiens
attcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatga

SEQ ID NO: 78836 - DNA, 88 bp, Homo sapiens
catgacaaacttcaagaagaaatacagaatttaattaaaattcaggctatagctgtttgtatggaaaatggcaactttaaagaagcag

SEQ ID NO: 78837 - DNA, 235 bp, Homo sapiens
tgtgaaaatggggataacagagcttgccctgcaatgagcttatgaaacttgaatgagataatttatataaattataatgtgcataatttatataaaaggccttacttggtactggtgataagagtgatacatgttcatttctttccttcatttccttctccttctttcttagagaaccagtaggatcttagcagagtttgaaaaaggctaaaatctctcctttccccctacccct

SEQ ID NO: 78838 - DNA, 491 bp, Homo sapiens
gaggctgcttttacaggttactttttatttaattagaagaagcagtacactctaaaataaccaatctaaaagtatacataaccctataacatagtcatttattatcaagaatcatgtgctgaacagaattgtgtaatacttttatatgactgacaacacagtaggtttgtttacaccagcatcaccacaaacacaaataatgcgttgtgttacaatcttctgaagactatgatgtcattgggcaataggaagttttcagctccattataattgtatgggattatatgtgtcctcatacatgtggtccactgttgaccaaaacaatgctatgtgacacatgattataccccagcctgtctcctagtctgtatttctcaaacttgaataaagttcagaaaatttttgaagaaaaataattttcaaggacccaaacaatgtcttcttaaagggttctggaggacactggttggagaaacactgacttaatacta

SEQ ID NO: 78839 - DNA, 900 bp, Homo sapiens
ggctttgtgtttgtttcatggacttgctcatcaggtctaaacacagatctgcagctgtctccactgctcttgtagacactgagtgtgacttcaagaaagcaaaagaagggactggtaaatgaagtcacacacagctgaggacttgaaatgtgtttatgtcagacagtcccctatgtcagccccaaagtgtgcctgatcttgcaaccctggatcctagaacctgcctgcacctccctgtggactagaacacacaggtaggcagtttggttgccaatgtacccaaaccaccaggccaggcgtctagcatgagcaagcgccacttctcttgcagaccactgactcccaccctctgctcatgctcacggatggcttcttcccattctgcagggattgggatggaacctgaagccaggtgctgcctgaagcctgtggccccgccaggcacccaaggaaagccggcaaagacttggatgtgtgttgtctttgtttttattttaggctcagaaagaatttgacagaagtcttctttctactgctcacctctcaggattccctctgtgacttaatttactctggaaggctgtcgcccgccctcaattatagatggggaaataggcaaggaaaggcatgactcagattgggggggttagagcagcaccatagttagaacatagatttacatgtgagcctttacatggcatagttgtggttttgttttagccttttatttagaaataattacagactcagagaaagttgcaacagaacgtacagggaggcctgcgtgcccttcagtttccccagtggtagcatcccccatcactgtagagcagcatcacagctgacaaagtaccgttgagcttcccctagccacagaacctattccaattttactgcttt

SEQ ID NO: 78840 - DNA, 1333 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78841 - DNA, 1371 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcaaaaaagacaaaaacacaaaacacaaacaaaaggggggg

SEQ ID NO: 78842 - DNA, 1355 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacttaatgcacgctttctatttt

SEQ ID NO: 78843 - DNA, 1735 bp, Homo sapiens
  misc_feature (1383)..(1383): n is a, c, g, or t
  misc_feature (1392)..(1392): n is a, c, g, or t
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcactcgtgccgaattcggcacgaggtcaaatggatgtaatatagggtttgtntgctgcttntgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccagactcgtgc

SEQ ID NO: 78844 - DNA, 1484 bp, Homo sapiens
agcggggggggctaagtggccaaggagagtgctttgtgagtctcttgttggaaggactgtctttaaattaaagcaattagagttactttataagatttacccaaatataagagctgaagagaataattcaaattgatcagaagaaaatactcaattactgacaaatgtcaattacatcaatagcctaggctgctcttgaactcctgggctcaaacgatcctcccctgtcggcctcccaaagtgctgggattacaagcttgaaccaccatgcccagcctcagaaattttttaaatgacagctcatacagttttcttttataaagccatgttatgatgctgcaagaagcccattgccagatgctggtgccttgacactggacttctcagcctccagaactgtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78845 - DNA, 1085 bp, Homo sapiens
caaaagaattccgtggcatgctggacctgcagcagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78846 - DNA, 1176 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaacacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78847 - DNA, 1281 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78848 - DNA, 1841 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggtgagagaggggcatcggggagaaggagggtggtgtggaaagaggatcctatgggatctataactcacaaaggacctgatatatattgatcttgttttttctagtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78849 - DNA, 1737 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78850 - DNA, 1260 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaaggggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaagggggtaagcttgtgctctactcatctaaacttgtttggttttgcccgaggagaacattttacagggctcctttcagtcttccttactggaaattaattttcaaaattatttgataaggacttagggaagaaagatggtattaattccccctaacgttctcaactatcctattagggaaaagtattttccattttattagagatgataagaacatgaatagtaagacatttagatgtgaatttaactaggtatccagcattatagagaccctaggccctcttcccttagagcctgggtgcaaaagctagggaaaagaagtagttagctacttcttacaaagaactcttgcttccctcctagttacaggtgttagtgggatggggtgttt

SEQ ID NO: 78851 - DNA, 1863 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggtgagagaggggcatcggggagaaggagggtggtgtggaaagaggatcctatgggatctataactcacaaaggacctgatatatattgatcttgttttttctagtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaaggggccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacttaatgcacgctttctatttt

SEQ ID NO: 78852 - DNA, 523 bp, Homo sapiens
tgtttcaggggaaaagtctctttcctccagcgttacggagccctcaccagcatttgtttccacagccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgca

SEQ ID NO: 78853 - DNA, 1768 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggtgagagaggggcatcggggagaaggagggtggtgtggaaagaggatcctatgggatctataactcacaaaggacctgatatatattgatcttgttttttctagtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaagggggtaagcttgtgctctactcatctaaacttgtttggttttgcccgaggagaacattttacagggctcctttcagtcttccttactggaaattaattttcaaaattatttgataaggacttagggaagaaagatggtattaattccccctaacgttctcaactatcctattagggaaaagtattttccattttattagagatgataagaacatgaatagtaagacatttagatgtgaatttaactaggtatccagcattatagagaccctaggccctcttcccttagagcctgggtgcaaaagctagggaaaagaagtagttagctacttcttacaaagaactcttgcttccctcctagttacaggtgttagtgggatggggtgttt

SEQ ID NO: 78854 - DNA, 949 bp, Homo sapiens
agcggaagggggagctgcgggccaggcggggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggatgctgcctgaccccaagaacgtgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 78855 - DNA, 985 bp, Homo sapiens
cggctagtaggtggtagaattaatactgcatccaggtcttctgactacggactgggtggtttccctccaacacagcaggaatagaatcaccgcctaacacagccacaagatggcaagggaagaaaggatgacttattacacagctaatgcaaagggatctttgtcaagatcttcaatggtctcccctcctcctccccttcagtggacatcgccgttctctttctctgcatctgcctcagtactggggagattctgggactgaacctaagattcagatggcagagagcaaagggagaggggataagatgggcctgcaaaaccttagtgataaccagcggaaaactgattcgttgttgcttcttttcattttattcttttttaaaaaaattttttcttattttataaaatctagccactatactaatgaggatcattttattattcactgctgagattgagaaaatgactttggatttactaatgtaaaagtataatgccatgtcccttgattgtttttgtttttcttttctttttagagcctaaagatagtaatgagcagcttgagtcttaagttttttaatacaccgatggaaggtgacaaagattctttgcttggccaaactttagtcagactcctcaaccttctcgtaggtttatctgtgcatttccttggaaaatccagttagaaccctctaccctcaatatctgatcaggttcctcatcctctaccatccaaggtgatgtctgatcaccttgacctattttcagcaagaaacccctttactcctgaagttccttcttagtaattttttatccagtgaccccaagctttttgttccttggctataaattcccacttgcccatgctgtatttagagttgagcccactctctctctcctaattcagaatcccattgccatggttgctatacctatcctgatggtccggaataaaatctgtcttactgtgctttaataaatatca

SEQ ID NO: 78856 - DNA, 1121 bp, Homo sapiens
tgcagtggctcacgcctataatcccagcactttgggaagccgaggcgggaggatcacctgaggtcgggagtttgagaccaacctgaccaacacggagaaacctcgtctctactaaaaatacaaaattagccgggtgtggtggtgcatgcctgtaatcccaactacttgtgaggctgacacaggagaattgcttgaacccggaggcagaggttgaggtgaaccaagattgcgccactgcactctagcctgggcaacaagagcaaaactctgtctcaacaaaataaataaataaataaataaaattaaatttaaaaagtctgaaccacatatgccaagctactatgaaggaggggaggagatttgccgttcatcaattttcactgcatctaatagatttcaatataattgcagtctgtgcgaagtctttaaaagagctcagggctttggagacaactatgaagaagtggcactttgaaaatataggacccggccagacacagtggttcacgcctgtaatctcagcactctgggtggattgcttgagctcaggagttcaagaccagcctgggcaacatggcaaaacttcatctctacaaaaaatacaaaaattagccaggcatagtggcaagtgcctgtagtcccagctactccggatgctgaggtgggaggatggctcgagcccgggaggtggaggttgcagtgagcccagatggcgcaactgcactccagcctaggccacagagccagactctgtctcaaaaataaaaacaaatcaaatcaaaccaaacaaaaaataggacccactgaataagtttcagtaaggtgaactgtagagtttgaacagcatacacacaataatgacaaggggaaaaatgacaagtctagctagacaagaggttcaggtaagatatcaacacgttaggaagaagccaaaggacagcatgacacaatccaatacaacttaatacagctcattttatttatggactaatccaaggcatctcaaccttggcattattggcatggggggggctggggtcttcgttggggagtgtcctgtgcaccgcatgatgtttagtagcattcaggcctctctacccactagacgtgagcagcacctt

SEQ ID NO: 78857 - DNA, 312 bp, Homo sapiens
tttttgagacagggtcttgctctgtcacccaggttggagcgcagtggcttgatctcggctcactgcaacctccacctcccaggctcaagtgatcctcccacctcagtacaccccctcaacagtatctgggaccacagacacacgccaccaccaattctttccctcaccctgccataacttgggttgctgccactcaagcccctaacagaagtcccaagccccatattcttttctgtagctcaggatgctatataagcttcaattatctgacccttctttgagcctcatattttgtaggattcctgtgtacaa

SEQ ID NO: 78858 - DNA, 639 bp, Homo sapiens
ctcaaaggtttactcattcaaacattttaatattttttttactagaaagaatagcaaagatttttttaagggtaacacagtgtacctaacaaaatatagagttatgagcaatctcacatacagctaatacagtgtaagttctagaggacaatttcacacaatgtatttcttgaagcttccaaaatgttcacacacttttacacagatgctagcagtgtatactaaatgccagacaccaaactaggcccttcaaccacaaagggttgcttaattaaatttacagtttgttgaatctcatgatattctgtattacagaccaagtatctattaaaaatacagcagaaacacaatttattgacacacaaaagatgctgtgtaattttcaaaagcaaacaaaaaatataagcaaaacgattcaactttttcgtaagtatatactataagcaaaaatacacagaaaaaaccccgtctctactaaaaaatagaaaaattagtcgggcgtgatagtgggcacctgtaatcccagctactcaggaggctaaggcaggagaattgcttgaacccgggaggcagaggttgctgtgagccgagatcatgccactgcattccagcctgggtgacagagtgagactctgtctc

SEQ ID NO: 78859 - DNA, 546 bp, Homo sapiens
tcaccatcatatcctcactaaagaaaatgctaaagataaattttcaggaaaaggaaaaagatctcagatgacctgagatacaagaatgaaagaagagaaaaaaaggtgatacgtggatagatgtaaatgaacactgtataaacaatgataaagtcttgtggagttaaattagaaggacaatattagaatattaggccagaataacataaaaggcgactaggaaggataaattgagatatttaaaaaatatatgacttccagccaggtgcagtggctcacccctgtaatcccagcactttgggagcctgaagtgggcagatcacctgaggtcaggagtttgagaccagactggccaacatgggggaaccccgtttctactaaaaatacaaaaattagctgcgtgtggtggcaggcacctgtaatcccagctattcaggaggctgaggcaggagaatcgcttaaacctgggaggcagaggttgcagtgagctgagattgtgccactgcactccagcctgggcaacagagcaagtctctgtctccaaaa

SEQ ID NO: 78860 - DNA, 251 bp, Homo sapiens
agccgtggtgaagggaaatcaatgtctttgagtccatcagttggttccatttctactccgtggccactttgcatatgagcccatcaaacagtcagtgaggtggctgggaaggaagttgactgatatctacagggctgataattttgtccactggtttattcattacctttcccactgtggagtagggtctttgggagagagtacactttcgggaaacttttctagatgctgatccacatacctcctcaaac

SEQ ID NO: 78861 - DNA, 621 bp, Homo sapiens
  misc_feature (548)..(548): n is a, c, g, or t
  misc_feature (570)..(570): n is a, c, g, or t
  misc_feature (575)..(575): n is a, c, g, or t
  misc_feature (597)..(597): n is a, c, g, or t
  misc_feature (604)..(604): n is a, c, g, or t
atttgctacattggatcggcaactaaaccattatgtaaaggctgttcaatctacaataaatcatctaggtgtggtgcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcttggcttgatcctcattctaagttgcgttttattgttgttgcaattctgtattttgtctaatttttggttcaaatcagcctgctcatttctggaaagccaaccagtttccacaaagtgctccaggaaatttncccagcaggctaggtaaggggnatggncccaattgctggggaagggganatttggnaaaccaaaataaaaggt

SEQ ID NO: 78862 - DNA, 420 bp, Homo sapiens
gagggttggagacaggagacagtggggtgggaaatccaaatctcaactgcttttgtactgtctcctgctcccgagtgccccagagcccatccagaccctctgctgtctatgatatcctgttcagccctcaactttctctaccatccctgcaactggggttcactgtgagccaaaccagtttgcttcttgttttctaaaagcaggcagcccttcaggactgtctcattcaaggcatttcccacctctcttctccactcatatcccttcccaaactgcctttcctcatttctccgtctccagggagagggactccaggctaccacagacaaaaatggtggtcttcagtcctacgtaagccaacctgtgtgagtgtgtaaggactgaggttgctcacaaggagacacacagagtggatgccag

SEQ ID NO: 78863 - DNA, 824 bp, Homo sapiens
agtgagctgagattgcgcctcttcactccagcctgggcgacacagcgagactccgtctcaaaaaaaaaaaagaaaaaaaatccttctgagaccaagaataagagacttctttatttaccattgtcctggaggtcctagccagctcagtaaaacaaaatacatataaataaaaagtattaaggattgaaaaggaagaaacaaaatctaaaaaccactatatatacattattagacttattagaaacttagaaagtttattgaatacaaggaaatatggaaaaatcaattgcatttttatatatcagctacaaatagttttttaaagttttaaagatagaaaatttatcatagcattaaaaatatcaagtacctaggactctaacaaaagatgtatatatctctagagggaagactgaaactttgttcagagacattaaagaagacataagtcaatggagaaatatgccatgttcagactcactgtctccttcaccctcctttttattgctctggatatagtaccctacctggaacccaagtcctgtgcttcagaaaacttcctgcctccagttcttccacgtggaggatcagtcagctacaaacaaatgtcagtataagaaggaagaactcggtggctcactcttgtaatcccagcactttgggagactgaggcgggcggatcacaaggtcaggaaatcgagaccatcctggctaacacggtgaaaccccgtctctactaaaaatacaaaaattagccgggcgtggtggtgggcgcctgtagtcccagctactcgggaggctgaggcaggagaatggcgtgaacc

SEQ ID NO: 78864 - DNA, 259 bp, Homo sapiens
gaccttgcattaggcaactgtttcttagatatgacacctagagcaccaatgacaaaagaaaaagccgataaactggaatttgtcaaaatttaaaaatattgtccttcaaaggacaccatcaagaaagtaaaggccgggcgcagtggctcacacctgtaatcccagtgctttgagcgattggggtgggtagatcgcttgagcccaggtgttcgagaccagcctgggcaacatggcaaaatccagtctctaccaaaaatac

SEQ ID NO: 78865 - DNA, 1181 bp, Homo sapiens
  misc_feature (1061)..(1062): n is a, c, g, or t
gaattctgaccacataaacagacataaattacctagcctggcttggtcctaacaagttctgtaggtagaaaagaatggcattggagaactgctgatgtggttgggttatctgtcattgcactgtactgctggcctcacatgctacagatgagattctggggtgtctgaagggagcctgaagtgatgggtaggtctcatctccacaataatggactgtcatccaaagaagaatcactcagcactggcaacaaaaataatccattaacctatatcttcctggcctcctaaagaaactctcccctcaaaaaatgtcccagctgaagttgttgccatactagctctggaatgcatcgatatcatcactcattttctcatttcagccccctacccttctttacaagctaactgatacaaccattcggcctctccaaatccctgcaatttttctctacatgtgggaactcagccatgggaacttagatggcttcaccatcctacgctttggggtcctaatctgtaaaatgaaaaggatactagcatctatcccatagggtagtcggatgtgaggattgagacacagtaagagaaagtgtttattacactaccaggaaagtcctcaattaaagtgcagtacgattgttatcgttcattgatgctaattgatcataaatagagtaattatatgccaagtttgcgtgtgacatttcagctttaaacttgtggtctcaacttagttatcaatagcatcccttttccttcacaaaatgttcccacacgctaccttaacgataaggaacaagacaagaaggcaattgttagaactcagtcatcatattagtataggcagaaaagatgatttacagtaaaacatctgcctcagcttgttaaatcctgactgcctaaggaacagggttggtgctagaaccagtgacacgactgagtttctgcaacaagccaagggtatcaaaaagccatgagtatatgacttcagagagatgtgatatttttcgtctccttgaacatttttttcttcaccctccctaatccagagagaaagtggnnattttttttttaagagaagtggtcttgctctgttgcccaagctcaagtgcagtggcacaattatagtttgctttagccttgaactcctgggcccaagtgatcttcctgtctaggtctcc

SEQ ID NO: 78866 - DNA, 855 bp, Homo sapiens
acagaagagaatatctacccataaccttcaagtcggtatcctcgtctaatccactatagcctcctatctgaactattcaatagcctaattggtttctctggttcttctcttgctattctacaatgtactgtccattcagcagtcaggatgaatcccttaaatgtgaatccaatgtttcttacctgctcaaaacactccagtgtcttctcatcacactcagaataaaactaaaattccctacatggccgactaggtcaagtataatatatcctctaactgtatcactctgactgtatcacttgaaactctcctgctctcctattcagctctagccatactcattgtatttctgcttctggaaatacctcatgtctttatcagaggctttgtactcactacttcctctgcctagaatatttccctcttcagatagctttatatgctccgtccattcaatcatataaacagtgaaatgccagctcctctaaagggctcttcctcagcaaccaatctaaaatagtctccttaaattgcttacactattctgtgtagacctttccctcacttcgtcttcatagcatttacggctacattagaaatgtgttaatgttgttctctctctcaaaagtgtaagctcaattaagtagcttccccataaatcccaagggaatgcttgcccgtagtgatgacaatttagtgaacagttgaataagttaatgaataaattgataccatgtaccaatgtatataagtagtaagatggatcatttatcccaaacccactagacttccacataattgtgacttcatttgaattttttcttaggcttaatttattaaagattcttgtggacc

SEQ ID NO: 78867 - DNA, 370 bp, Homo sapiens
ccatttctgttcactcttttcccccacatcccacaactatacagatagggtaaaagagaatcaggtggatcaattaattatggcagcccacagaggtgctcttaaggtcccaggaaaaccataaaggaatagctctgggcgaactctggaatgctaacaatgcagaggccacaaggtagctcaaatcaatttaaccgatatttaataggcacctcctatgcacaagataccatgcagagatatacactatgatgaatgagacacaatatttactctcaaatatgttatctagtaaggggattagaaaagctatgttagtaagttcatacaacagctgccatcaaaggaataagccaacaccagggatatg

SEQ ID NO: 78868 - DNA, 478 bp, Homo sapiens
gtgagtggacttaagaactgaactgtactcttactaatggctcagatggtagattctgttatgtgtaccacaaccgaaaaacaaaaaatgggatacaagtgtcacctcattaggctcttgtgacataaaatgagttcattcacctaagtgcccagaacaatgcctgacccatataaaacgtgcagcaaaggttaactgctcttgccattttgttgttgttgttgttgttgttgttgttagttaagggctgagccttgggaccccagaaaataggttccttttctacacattaatcaattagcacgaacaaaattacgaatgcagtagtccttctgctgtcaattacaaagacatgctgcagtggcacagagttgctctttcacaaagactttccctgggcgttggtaaaacaccggggtgtaatagagcaggcagaattttcctcctcacacagaagagatcctgtaatctgcctgag

SEQ ID NO: 78869 - DNA, 281 bp, Homo sapiens
gaccaacattctctcctctccttatctggaaagccccataatgcctccttagtattaattctacctcaagtccccaaattcctggttgttgttaattggcttatgagagtcatctaacctaagaggaccaatcaaattctctctctgacaaactgttattaaggttcaagaagcctagttgttcttcataatatgagtgaatggaaaagacatttcattttgggggtgtgatggttaatactaagtgtcaacttgattggatcgaaggatgtaaagtattg

SEQ ID NO: 78870 - DNA, 658 bp, Homo sapiens
acaggctttgagttgtcactgccatttgtttatttgtttgtttcttgtctgagatggagtctcgctctgtcacccaggctggagtgcagtggtgtgatcttggctcactgcaacctctgcctccaaggttcaagtgattctcatgcctcagcctcccaaaaaactgggattacaggtgcacaccaccacacccagttaatttttgtatttttagtagaaacggtgtttcaccatgttggccaggctcatctcaaactcctgacctcaagtgatccccccgactcagcctgccaaagtgctgggattacgggtgtgagccactgcacctggcctgcagatttaaaaaaaagtatgcactgtttcacattaaagtataaagtcgatctgatattctatgaaatttctttagtctatgcttcttttagaaaaaagcaaataagggcagaattctctctctaggttctctacattccagattaactgagagttccagattaattagataagaagtatatatataaaacacaggttccatataaaatttaaagtagtttttttctgattctgtgaagaaagtcaagggtagcttgttggggataacattgaatctataaattacacaatagcaaagacttggagccaacctaaatgcccatca

SEQ ID NO: 78871 - DNA, 812 bp, Homo sapiens
atggagtcactcaccttagagtctgaattctgctaagtcaccatccacttcaaaaacgagttaactgaatccaaaggcctaaaaacagaatcttgggggagggggacaaagacaacagggggtctgtaagagcatttatgtaactaggaacatctgttttgggggctctttcgtagtattgtgtggaaataagttcaactactaaactctaaccataaaacagacacaaaaatctaatacagaaagctctttagagatcatccatcagagtagaaccttagtcatagaaactcgctcagaacataccaatctaaataaccaaactttccaagtgccaataaagatatatcaaatatgaactcttttggctataagtctgaggctcattacatccttctctgtcctttttaaaccatgtctgagaaacagaaccattaagtggagattaagtcatcactcattcagtttcactacacaccagtgataacttagccacacagatattaccaaagtgacccaaactcatatgctgtcccagtgcaggcctgtctccttctaaaaactatcatcaagatttcaaacatcatatgaaatgtaaaaacatgcatgggggctttgtggcatttattttgatctgacaccaacttttgctattctcccaaatccttaatatgttcagatatgttgttgccagacgcccccagtacctgcccaactggcaaatccagaggcttcttgtccttccccacctcttgaaagcctgccatcattcttcctacacacagcaatactactaactcccacatcaaatt

SEQ ID NO: 78872 - DNA, 788 bp, Homo sapiens
taatttcttggacactcacatcaagtaaatccttagtactacctgacaattgtacttttatttccattatattcaccctttagtttcctgtagaacgatatcatactttccagcttttaatccttttctctcatattagcaaaattccacagaatgaattgttcatattttctgtctacagtttccacctattttatgaacccattccacttatccctcctcccccatgtacagatctagctacttactcaacatctccttctcttagatgtctaatagacatcttaaactgaacatgtcccaaatagtttctgatttttccttctcaagtcttaagatgagtgtatatgtacatacccatattcatacccataccgcattcatacccatcctcccacctagatttactgttcttaacattttaaacaagtaaatataagtaaatagattttcccccaccaataaaaagtaaggtccatgacagcagatggttctctgttttgtttattgctgtatctgcacctggtacatactagggactttaaaaatatttgctaaatatactacctacttagtggaggaaaacttcataaagctgtacttgccattgcagggcttaatgcttgcattcctatatgttatactattcagttatgttgtttacaaataaggcacagcccactaattcccactacatttatttcactacctacaaatggacagtttgaccaatgttagtctagcggctaggccatctatatgttgatttcaccttcttacctatctct

SEQ ID NO: 78873 - DNA, 377 bp, Homo sapiens
taatttcttggacactcacatcaagtaaatccttagtactacctgacaattgtacttttatttccattatattcaccctttagtttcctgtagaacgatatcatactttcttgctctttaagcagatatctttgctatctttactctcagctgataaccttggttttggtttcactcagaaaatagaggcaagtagaagaggattttcacaggtttccaccactgcattgacccacctacctgcattgtgccctataaactaagcctttcccttggtgctgtgggtaaacttaagttcttagccagggcctactgaaggacactgctttagtagttctttttgctttcaggcatcattactttttccttttttgatg

SEQ ID NO: 78874 - DNA, 778 bp, Homo sapiens
taatgcttcagatagcagaggaccgacagctgtgactttatttggtgatggaataaataagagtctcactgtgtcacccaggattggctcgctgcatcacccaggatcggcccactgcaacctccaccttccaggttcaaacgattcttctgcctctgccttttgagtagctgggattacaggcacgagccaccatgcccagctaatttttgtatttttagtagagccgggctttcaccacgttggccaggctggtcttgaactcccgatctcagatgatctaccaaccttggccacccaaagtgctgggtttacaggtgtgagccaccatgcctgacctccaatttcatgaacttctcaggccctctgtgcatgccatgcttaataaggtaataaaaaggtaagattataaagaaggaagaggcctatcaaggaaagaaggctctttatttgctttgctgtcatggtatccttcccattccactggcttccagcacatatgtggaaacttttgggaaagttccccaaaactttggggaactgtgttccccctgaagtttggagggtgaggagtgaacaggaggttgagaagaatgagctggctgggttggacattcagaggtgacaatggtcagatcaaccttgatggagtcttgttctgtcaccaggctggagtgcagtggtgcgatctcaagctcactacaacctccaactcctgggttcaagtgaatcccctgctcagcctccctaagtagctgggactacaggccaaccacaa

SEQ ID NO: 78875 - DNA, 208 bp, Homo sapiens
ggagggtggggcatgggaggagggagagcatcaggaagaacagctaatggatgctgggcttaatacctaggtgatgggatgatctgtgcagcaaaccacaaggcacatgtttacctatgtaccaaactgcacactctatatcctgaacatgttcccttgagcttaaaagttggaaatcaaaaattaaaaaaaagaaaaaaaagaaaag

SEQ ID NO: 78876 - DNA, 986 bp, Homo sapiens
tctgttctccagtcccatttagttcccaaaggaatcatttacaaaccattgtctgatcttccggcccatttatttacagctccccctctttccccaatgaaaatgatacttaagtgtcagccatctatcggctctttgagttttcacattttgtatgactcctgtgcacacacatgcatgtaataactgttatacttgttaactttttttcattataggggtatccaccatgattatatatgatggggaggaaagggattactccatttctgcccctgcagtctgtaggcatgattgattacatcattggtcgccggtgattaactcagtctccaagccctgtcgtgtccctggaggttggagggtggcactgaaagctccaaccatctcatcatgctttgatctttccgatgaccagaccccaccctgaagctatctacgggtccccagcaacattcatttcgttatcatacaaatgacattcttacaatttcagagattccaagggctttaggaaatggagatgaagagcaaatatatatttcacaatatcacaaacatacccttgggaattagacctctgatctaatctaggctccctcacttgccatttttgtgaccttgaacaagttgttcatcttttctggatagttctctgttaaaaaaattaaaataaaaaaatggtggctatcaggttgttaggaggactagataagagaactatgtgaaggaccctgcacagtgctagcaacaaagttgtttagtaagtgctatttcaatttattttgcttccaagctcatgtgagctccctcagtgtgtaccaccaaatcacatgatgtgtatcccagtcaaatcttaaaggtcatccaccttgaatctttaagttaattaacgtgtgtttttaaaactgcattataagaacgttagggtttttgttttgatcctatggaagttaaattttttacacaagcattcaactgtttag

SEQ ID NO: 78877 - DNA, 416 bp, Homo sapiens
caggtggtgcccaggactaatgcctgtgagctcggcgtggcaccaggtgatgcgaacccctaacaccactgcgaatccctaacaccactcagtcgaaccgcaggcatgaggcagggcctggccatgggctctccttcaccgcctgggcttcttctccagggagggagctggggtggcatggagcctgcagaccggaagattcttccctgactggggcttgcctcagaggccctgggcctggctggggttccatattgattcattctcacatgggggacccctcggttctctgaaatccctgccccccatcactgcatcactgggcactgctgcccaccccaagcagttccttgggaaatggtgtcttggttctggctgctgtaacaataccagaggctggtaattcatacacaacg

SEQ ID NO: 78878 - DNA, 149 bp, Homo sapiens
cagaaatcattttctgttacgaaaatattaagataatttttaaacaatgcattctgaaaaacaacaaaataatcctataaaatcttgagctctgaagtgctgtgcctgcagcccaacatactgtgttccatcatctttcctttcccatt

SEQ ID NO: 78879 - DNA, 924 bp, Homo sapiens
agcgggttttagaggatgacaggtgctgtggagttgggagactgagactgtcaggagcgaggagggatggctgtaattttaaatagtggcatcatcaggatgaaccttgctgaactgaagccccttccatgacactaaagtaagaagataattctggtcatttcatccaagcccttcagattggcaggtgtttggttcaaacatatattcaggacatgacttattttgatatttgaggagccctcttctctccatcccctccggaaaaaaaaaaagttgattttccttgtgattcttctggaactccgaggcaacctgttttcccaagaacagggcaccgaggtggtcgcaagggtgcggagggaggatcgcccctgtgggagaggcgcgccggtctctctcagggacctgtagctacacgcagaagatgctgccaattgcgcggaggtctctgacgctgggtgctgaggacattgtactaatttaaatggtatcagagtgaacacgatgctacatgtagaatgaaacttcccaagccctcacctgaagagacaaggctgaagtcataaacatcatacgtggaaaagtattgcaaacctgcttctcttctgtgctggggtctgtaccaatgttcattgaaccaaacaaggtccctatcttacagaagatgcttcttgaaggatggcgtgttaatcttctaagtatgttctggttgcgaggatagagcactgtcacagctacagctatacctgtgcaaagccaggaataacacgctccctaggagagtctctagccttaatctgtagctgcaaatagaaatgacaattcattttctcaataatgaaatgtttttgggtagggctaaaagcagaatgaaccaccaaaaagccccttttgacatggtgcctgtgtaaagacaaaaaa

SEQ ID NO: 78880 - DNA, 790 bp, Homo sapiens
agcgggttttagaggatgacaggtgctgtggagttgggagactgagactgtcaggagcgaggagggatggctgtaattttaaatagtggcatcatcaggatgaaccttgctgaactgaagccccttccatgacactaaagtaagaagataattctggtcatttcatccaagcccttcagattggcaggtgtttggttcaaacatatattcaggacatgacttattttgatatttgaggagccctcttctctccatcccctccggaaaaaaaaaaagttgattttccttgtgattcttctggaactccgaggcaacctgttttcccaagaacagggcaccgaggtggtcgcaagggtgcggagggaggatcgcccctgtgggagaggcgcgccggtctctctcagggacctgtagctacacgcagaagatgctgccaattgcgcggaggaaaagtattgcaaacctgcttctcttctgtgctggggtctgtaccaatgttcattgaaccaaacaaggtccctatcttacagaagatgcttcttgaaggatggcgtgttaatcttctaagtatgttctggttgcgaggatagagcactgtcacagctacagctatacctgtgcaaagccaggaataacacgctccctaggagagtctctagccttaatctgtagctgcaaatagaaatgacaattcattttctcaataatgaaatgtttttgggtagggctaaaagcagaatgaaccaccaaaaagccccttttgacatggtgcctgtgtaaagacaaaaaa

SEQ ID NO: 78881 - DNA, 248 bp, Homo sapiens
gtttgtaaatgtatgattttgcttttaagcaaaacctgtgatcggttccaggggcctgggtctggatctggtgcagaatatctaacctttccagcaggcaaaagcagagaagaggggatcgccatgcattggaaattacttcccattcatgtcatccaaatcctcacacaccaaaaaaaattccatattttttcagtaagatagagtgagcaaggaagcaggaaaaaaagagagatgtgaactcctgc

SEQ ID NO: 78882 - DNA, 260 bp, Homo sapiens
aataatcaaaaatgcaaatttactggttattaatatttaagtaaagctatgcctcatgtctttgaatttaacatattactaaaacaaaaccatacagtgaattttctccatgaagaattgagtccaccatgtgtctaatatttccataaatattcttagtttctttcactgctcttgaacggacctcgtatctcttaagttcatctaaagtatcaacttaataaaactttttctttaccgtacttcttatggaacaaaaa

SEQ ID NO: 78883 - DNA, 425 bp, Homo sapiens
tagactgagctaatgagctaagacatggtttcctggtgatccatgggacctgaggagaactcaggattcttagaggacttggagctctgtagaccagattataatggtttaagttctaacttcacctgggagttggtgtgttttccattccccacagaagctgtacttcaagctatgttgatccctgctcactttctcctttctaacattcttgcctcagttttcctccaatggaaccctctacttctgcttgaggaacagtcattgcccttaatatcagctccccaccagaccataagctccatgagggcatggactatctctgttctgttgcctgccagatcctgagcaactggcaatagaagttcttaataaacatggctggatgagtaaataaagtgtcagtcctttaaccaaaaaaaaat

SEQ ID NO: 78884 - DNA, 427 bp, Homo sapiens
cagggcttcagttcctcactggtgtaggcgtcttaatatgttagcttgcttaatcaaagcatgtaagccaagaaggcaacagagagggtgccagtgaaatagaaataactgtcttttgtaacctagtcatggaagtaacatcctttgattttttttgtgtgtggtagaaataagtcacaatgtccagcccccacacaggacataaataccagcagacagggatcattgagagccatgtcagaagctattttgccttagttatataaaattatgatagactacattgagaatgagtttatagacaatctgtttagtttttttgtgagtgcaaagcccactattaattttgtgggaatttttagtatgggtaaattctttttaatatgatgtttaacaggaatgctgcctttctgtttctttgcctcag

SEQ ID NO: 78885 - DNA, 411 bp, Homo sapiens
gctgctgcctttggatggggcctgcgctccccagttttacaactccccatgtaggcaccctcccttgctgatttgtgccatttgccaggctcctgtaggcatttgagttcccagccctgccttgactgtgtctcataacttcctgtaaagcccaaatcctcccgcatggcacccaagatgaccccaacttacagtttctccttcatcctctgctctaaccttacagaatgatgtgccttttcttgagtttttcaagtctccttcacctggaatgcttccttccttcacctggaatgctttcttccctgacacgtctccagctaatggaaacccatgctcccagtaagacttcactcaagtgtcgtttgcttgatatttttgaagccttctccagctaagctatctgctcac

SEQ ID NO: 78886 - DNA, 637 bp, Homo sapiens
aaattcttgccagtgctatttgatgccctgttgaactttagccaaacttcattttataatgttctctcagtcctgagcatatataatatattttaatgaaattacgcttctgtattgactggcagacatcagaaacacattcacataggtcaaaagcagttgagctaagtgttgggtgggaggaactattaaaacagtacaggaaaaatatttggaaacaaaacaaaactttaaaataaaataacccaaataaacaattctctctctctctctctctctcacacacacacacacacacacgcacacagaacttggatgtggctattgggagttaatgtataattctgataatttgtgtatttcttcattatattaaacttggaatttatatttttgacattattccaaaggtgtaataattgacttttaaaatagaataacattgtaatgggatcatattaagcatatattaaatgtaacacaaataagcactgagtctacctaaagtggtatttttttttaattttgtggctactcaggggttttgcattatattatcaaaagctaacaaccttaaggccatttgtggtaattcaaaaaatgttcaagcatctatgcttgatggctaagcttatat

SEQ ID NO: 78887 - DNA, 283 bp, Homo sapiens
ttggcctcccaaagtgctgtgattacaggtatgagccacctcgtcaggcccattttctaaaacatttaaaaaagcaactcctgaaagtcaaaggcaaaataaaacaaatgaaactggttgtgtaatgaccagttctatttttataaattgtgactgctctctgattagctcatagaaatctaagtacaggtagtggcttcctttgtaatggaggtaacccatgttctgaagttttttctcttggaattttctacaaatctcacatatctatttttggcattcc

SEQ ID NO: 78888 - DNA, 422 bp, Homo sapiens
caggtacgtactttggcgtctgaaaatgagcggtctaaattcaagcattttgacatgaaaaatgaaatgtgaagtatttggaattcaaccctgaatttttttgccggtaactcttgtgtatgttcaactaatttagcaaactgcactagttcacattttttaggtgaaacaagaaataacagaagttgcacctaaagtagtcaaatttcgtagagacagaaagtggaatggtgcttaccaggggctgcggcactggaaaggaacggggagttagtgtttaatggggacagtttcagttttgcaagatgaaagcatcctggagaatggttacacaacattgtgagtgtacttaatgccattgaatgcacacttaaaatggttaaaatggtaaattttatattgtgtatattttatacagtttt

SEQ ID NO: 78889 - DNA, 273 bp, Homo sapiens
acaggaagggtttcatggaggctgaattataccctgattaagacagaagctgtcctctgaatattattataaaactctatgaagcaacttggaacaattagggcatctgaatcggaaagtgctttttggttacacttcttaccaaataaactggaaaaaatctgttgtttctgagaaataaaacagatccttttgtcaatggattcatgcaattggggaagaaaaggtgacagcacagtcactacattcaactagattaccaaataacaagca

SEQ ID NO: 78890 - DNA, 513 bp, Homo sapiens
attcaaatttcttcctatcctaggcaacacttgatattactaaactttcacgtttgcctatttaatagatgtaaataagtattttggtgtttttatgtacagttatctgattataagtgaggttggatatctcttcatctacttgttagtctctcaaggttcccttctataaatctgcctgttcatatcctttggctatttttctattgcatttcttttttttctcagttatttgtaggaattcttaatactgtatattctagatattaatcttttgttggcttcagcctttgaaaatactttccaatctatcaactttctctaaacttgtttatgatgttttttgttgaacagaacagtttaaaattttgatgtcatcaagttcatctttttttgattttatagtttatgctttgagtcttgtttaaatgcttttcttcttttttctaccctaagattacaaagctattcttctatttttaatttctattagttttaccttttacttttagg

SEQ ID NO: 78891 - DNA, 370 bp, Homo sapiens
gagttcttcatctttccctgggcaactacatgttactacgttttctttccactggtctatgaagaagtaaacattagcttcatcaatatacataaatggtcagaactcaaagaactccaaatgaagaaaattcaccctggtagaaggttatttcagcatacattttgtaaggcatcttcagaatagcactagatgcctaaagcacaaatggaccttttccaagaatctggaaggaaccgattctaaatgtgaaaggccaaaaattctgtgtctgattgcccaagcccctctgttggtctttggtctagaacacatcagacaaataaagcaattcctgaaagcacactacctcactctgccagccaccccc

SEQ ID NO: 78892 - DNA, 568 bp, Homo sapiens
cccatacacagtccactgaattctactcatgtcccctttttggtctcttgtgtgcatgtccctcatttctattcagagccagaactcttgtttagattcaaatgatccacagcagcagctagaagacagagactccataggctaccagctgtgtgatcttaggggaaagaaaattatctgtgcctcagtttccttacctgtgaaatgggaataacagtatttactgcataagatttaacaattgaagagtgcttagaacagtgcctggcactcaaatgttagttcttactatgaactgtgtaatagcttgccaactggtgtaactctgttttctctctccatcaaaatatatttacattgccagcagattcatcttcttaaactactcacatatctgcttctgcaaacagaaaaagtccaatttgcttagtctggctaagaataatgtcctcctaaagaatgaagcctactttcctagcggaccttccactagtttccttcacaaaaaccatctgttccaataaaacaaattcactcattttcccctaaatattttcatgctttctgc

SEQ ID NO: 78893 - DNA, 286 bp, Homo sapiens
agcacagcagttgatagtttggtttaaagagaaaaaaatgggattagaggtcagaagatttcagtcctaatcctggccctgccacttggtaccaagttttgtaaatttaaattctcttatcctcacttagcctgtctgtaaaatgggattaatgatgttggttctgtctatgccacaagattattgtgagtataaaataagtgtataaataaggaaactataaactacagtacaagtactgtacaatttatatgtaataatgttctttatattacttgattttttt

SEQ ID NO: 78894 - DNA, 481 bp, Homo sapiens
ggctctacaattatacacctgtgccttttggcatgaagttttgcattaccttccactattgatgttcaacttggccatatgacttgtttggccaatggaatgttggtgaatatgatgagaggagaggtgttaaatgtatttgaatgatttggcttgacctcttgccagaaggagacatgtggtgaagacttgaatctgacctgcatcctggagccaagtccagctgaattcagctgaacccaaccaagtcttaaggagcccagatgagatgagctgaatctcagttcatatacagacccataagggagaaaaataaatgactaccataagccactgataagttgggattatctgttacataatattattattgcagcaagcaatagctgactaactcaacatgatttcctcatggatttgtggtgttaccatgatcacatatcagattctcttatgtaaatgggttgtttctgagttctct

SEQ ID NO: 78895 - DNA, 282 bp, Homo sapiens
ttgagtactcatttgaggactgcagtcatagatttaaagtgtaatcagtcaactcagtggaattactttctccattaatcttaaattgcttcaggactgtttcagcctaagccagtagctgggtttaaccaaatttgaagatttttctaggagagtttggcacgaggagagaggggcaaaggcgtgtaaggcagtgtttataacagtggcccatggaattgatcatgggtaaagagaaaacaaggacatgcgaggaggtgataaatagaacaaaacaaagca

SEQ ID NO: 78896 - DNA, 774 bp, Homo sapiens
aggagccagccctgtgcaccctgtgtgcctgtccatctggaaggcccagcatgagaggcccgaccgtcctcctcactgtggctctgcccacgctcctggctcccagggccggggcaccggtacaaagtcagggctcccggaacaagctgctcctggtgtccttcgacagcttccgctggaactacgagcaggacgtggacacccccaacctggacgccatggcccgagatggggtgaaggcacgctacatgacccccgcctttgtcaccatgaccagcccctgccacttcaccctggtcaccggcaaatatatcgagaaccacggggtggttcacaacatgtactacaacaccaccagcaaggtgaagctgccctaccacgccacgctgggcatccagaggtggtgggacaacggcagcgtgcccatctggatcacagcccagaggcagggcctgagggctggctccttcttctacccgggcgggaacgtcacctaccaaggggtggctgtgacgcggagccggaaagaaggcatcgcacacaactacaaaaatgagacggagtggagagcgaacatcgacacagtgatggcgtggttcacagaggaggacctggatctggtcacactctacttcggggagccggactccacgggccacaggtacggccccgagtccccggagaggagggagatggtgcggcaggtggaccggaccgtgggctacctccgggagagcatcgcgcgcaaccacctcacagaccgctcaactgatc

SEQ ID NO: 78897 - DNA, 963 bp, Homo sapiens
ttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcacca

SEQ ID NO: 78898 - DNA, 671 bp, Homo sapiens
ctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgct

SEQ ID NO: 78899 - DNA, 703 bp, Homo sapiens
ttcctggttcatactggagagaagccgtttcggtgcacttttgaagggtgcggaaagcgcttctctctggactttaatttgcgtacgcacgtgcgcatccacacgggggagaaacgtttcgtgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgct

SEQ ID NO: 78900 - DNA, 611 bp, Homo sapiens
ggttgcagtgaatcgagatcatgccactgcactccagcctaggcaataagagtgaaattgtgtctcaaaaaaataataacaataaaataaaataataaacaataatgggccaatgatcagcagaactgagttctagacatacatctgctgtttggtagatcacttctgacttacgatattttcaatttataatgggtttatcagaatgtaaccccatcataagtttaggggcatctggccttcactgggtgaccaactatatggcttcctcaggtgaaatcaatcaccttattttatgttcacctctatatctatcaatgttccaatgagacggttacaagatatatttatcagaagaatgaggaatgtagaatgatatgttaaacatcagcctggatgtataaattctaatatgcttctaaatatatatatataatatgtagcaataacacatattattactacgtataaagcttgtacatattttatgctgtcttggaaggtagataagctcttaaagaacatactgtacaatataaataccttaagagcaataaatagaaaccactgaaacaacagcccatacaatttagcttttaaaaacctttcta

SEQ ID NO: 78901 - DNA, 996 bp, Homo sapiens
agaaagagccaatctccttgagacagaagattttaaaaactgagtaaaaaattttaacaaaggtcataaattatttaatttacagaaaaggaaataactcacaaaagagtgttcgttctcattcattagagaaacatactgaatcatttttcacttatggtattggcaaaaatcaaaacaaacatctgttggttgataacacatggttatggcaggaatgtaggaaggctgtgactcctaggcatctgctgggatgacttgtatttttggtgtgcattagcacaacctctgttgggggctatataacaatatctatccaaactacatctttagtgatccaaaattccgcttctgggaatttatttggtagataagcttgcatttgtatgagatgatccatgtaaaaagttattttttatagcactgattatgactgcacaaggttggaaactatgcagatgttcactgctggagaactttcatgcaatggataccactcaactgtgaaagaaaaaagagataattctctctatagtgaagtggaaaaacctccaagattaactttgcacagaaagagcaaaatgcagagtggtgtgtatggaatgctatctttagtgcaaataagaggaaaaacaagaatatatttttatttacatttttttaagttaacaagtaatgtcataacactcactaggtgtcaggcactttataagtattaatttaatccttctaacttcaggagaagggcagtaggaacagagaggttaagtaattagtctaaagtcacactgcaagtcacctaaaggagccagcattgacacccagggcctccagctccaaagttcctgttcttaagcatcatattaagcagactaatttgaagttaagaaagggagggtgggagggaggactgggtggatgggagacttacgtgactttttatacatgtattttagaaccatgtacatgtgttacctattaaaaagttgaattaga

SEQ ID NO: 78902 - DNA, 853 bp, Homo sapiens
  misc_feature (853)..(853): n is a, c, g, or t
ggaggtcagaggcgcggagaacatgagacccgaggtctcaactgcttcttaccaatattaattccagtgactactatcagaatatgatgagcaatccactcatcagagaagctgtttctacactctcctgaatgaccattttatagatgctgggaaaaaattgtattaaagactatgagttagctgggcttggtggctcacgcctgtaatcccagcactttgtgaagccaaggcgggagcatcgattgagcctagcagttcaagaccaaccttggcggcataagcgagaccctgtctctacaaaaattttaaaattagccaggtgtggtggtgtgcacctataatcttagctacttgggaagctgaggtgggaggattactcagcctaggaggttgaggttacagtgagctgggatcacaccactgcccttcagcctgggtgacagagcaggaccccgtctcttaaaaaaaaaaaaaaaaaagtggtggactttggttatccttatgcatatgactcatcaatatatctgtatttccatatagaaagaacacttagaccgggcacagtgactcacgcctgtaatcccagcactttgggaggccaaggctggcggatcacttgaggccaggagttcaagaccagcctggctaacatggcgaaaccctgtctctactaaaaaatacaaaaattagcctggtatggctcggtgtgcacctataatcttagctacttgggaaagctgaagtgcgacggattactcaggctacgaggttgaggttccagttgagctggggatcacgccactgaccttaaacctggggtgacacaaaaccagggtaccccgtctcttan

SEQ ID NO: 78903 - DNA, 273 bp, Homo sapiens
gagccagactgcactttgctgtgtgggatctagaaggtggcgtgctggaagctggtgctgagtgatacatggggacaaggtgggagtgagagagaccagcaaggcagtgaagagactggagagagactgaaggggtcagagaaagggcagagcattcagcatgggagaggcgaagaagactttgaggatattttgttgaacaaggcatggtgtgcaggtgacttccttaaaaacattcctctggaagcagaaaatagatgattaccaggggct

SEQ ID NO: 78904 - DNA, 738 bp, Homo sapiens
agcctggggtaaaggggcggggccttgtggttggcatagcaacagacatgggtcaaactcacctgggggttagggcggggttgtttgtcactaaggaatcattgctgaatgacactacagtggagaaccagagccccgggcttttctaaacaaacagccctggtcactgctgaattcaaagtgtactgccggggccgggcgcggtggctcacgcctgtaatcccaacactttgggaggctgaggcaggcggatcacgaggtcaggagatagagaccatcctggccaacatggtgaaaccgaaaccccgtctctactaaaaatacaaaaattagctgggcatgatggcgggcgcctgtaatcccagctactcaggaggctgaggcaggagaatcacttgaacccaggaagcggaggttacagtgagccgagatggtgccactgcactgcagcctgtcaacagagcaagacttgtctggaaaaaaaaaaaaatgcgcaccgccgggcccgcctccctcagcacccaatgctggtcggagccctcgggcaaacaaactacctcctgcatccgggaacttaccctccaggcggaaggaaagaatgcggggacagagacctgtcctgggagaagctccttaggagatgaaggagcaccgaaagatgcctgacgtttttacgactcctctttcatgtttgtgtcccatctcttctcagaagaattagccatgttttgtgaattc

SEQ ID NO: 78905 - DNA, 270 bp, Homo sapiens
gaaattacccatggtcatatctagcctacaaagaagagaaaatacagtgattcaagtttcattgtattcctctcattgatatatttatcaaccttccaattgaaggaagtgtcttctaggcctttacaaagaatgtaaccagggtttaggtatacaagttgcatatgataaatctgtcatgtttctatataaatctgtccatattcctcttctgaaatgcattatttttgggggaaattaaaatgtgatgcaaagatccttatactttgt

SEQ ID NO: 78906 - DNA, 889 bp, Homo sapiens
tttactgtatattttaagcccactgttgagacctactgcttgggaaaaaaaaaaattcctttcaaaatactactgctgattgacaatacaccatgttacccaagagctctgctggagatgtgcgaagagattagcattgttttcgcgcctgctaccacgacatccagccgaagcccatggatcaaggcgtcattgtgactttcaaatctaactatttaagaaatacatttcaggctgggggaggggagaaaaaagaaaaaaaagaaaggaagaaaaaaatcatttcataaggctatagctgccatagatagtgattcctctgatggagctgggcaaagtaaacagaaaacctctggaaaggattcagcattccagatgccattaagaacattcaggatccgtgggaggagatcaaaatatcaacattaacaggagtttggaaaaagtgaattccaaccctcttggatgactctgaggaattcgagacttgagtaaaggaagtcatgcagatgtacagcaagagaatgagaagtggagcctgaagatgtaactgaactgctgcaatctcatgatcacacttgaatggatgaggagtcgcttcttataaatgagcaaaaaagtggtttcttggctgcaatcaactcttgttgcagatgctgtgaacactgttgaaatgacaaaggatttagaatattacgtaaacatagttgataaagcagcagcagggtttaagaggattgactcctattttgaaatgagttcggctgggagaagtggctcatgcctgtcgtcctagcactttgggaggccaaggcagacagagcacctgaggtaaggagttcgagaccagcctggccaacatggtgaaaccccctctctactaaaaata

SEQ ID NO: 78907 - DNA, 3578 bp, Homo sapiens
acacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtgtggggttagccaccagaaaactgggaaatttggccaaacccactgtgatcatcagcaagaaaggagatattataactatacgaactgaaagtacctttaaaaatacagagatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcctcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtacaagactttttgtaaacataggagtccctttattttaaataaataactagtcatatcattaggtccagtaattgttgacaggcaggaacgggggaccattgcattgtgcccaagtaataataaaactatttcagatgtattatatgattgagcaaatgagaaaacatgttgatgttgatgggagtcaggatgttcactatggaaaaacaaatatacaaatatgaaatgagggaaggcaagaaagaaccatgtggaaatggaatagaattggtataaattcataatttctaaaccatgtatatgtacgtttatatgtattataattgcatacacatgcctccatgcatatatgtgtgtgataatacacatgcatttatgtgcgtgtgtgtatacacatgcatatatttactaatcctatctgccaaaatggcttagacacaaaaacacctcagcagaaatgaatatacctagcactcagatcttcgtgtctaatatagtttgccactaaaaggaaccaaggctacttggaaaaatggatgattccaaagcaagggcaaggtaggaacaagatgagcttgaaatatcttgttatgccagaaagtaatgttaaaaaaaaaaaatagaggtatattgccaaaacatagagccagcttgaaggggctcccactggccaaacttgagccaatctgagagcaaaataattgagaaaaataaataacaagataattgagaaaaaaataaaataaattcccaattccattgggaaaaaatagaaatccatgaatccatactgatataatgatagataatcgatagataggtagatgactgacagatgatagatagatatatagatagatagatagatagatagatagatagatagatagatagatagagaaatgagaaggtttctcttttgcaatagaacgtcatggaccagtgttaaatgtgagtggaaggagttctggaattggaaaaccatcatttttcaaccatcacagtaaatatggctcaggcaagaattatcaatcaatgctaaagctagggggaaatttcgcttaggagcaggatattagggtattagtctgggcttaaagtatctcctcacagattgttgttagtttctggggaaagaatagtaaccatgcaatggaaaaaaatggacaacctcttgactaggttatcaaaattaacctcaccaataaagggtggatgttcaacatgtgccttcaaatgtgacccactgagaaggaaacaacatcactgtaacaacaacaaccagaaacgacagggggttttgactgaattcttcaaaaatgtcaatgtcatagaagacaaagaaaggttgtggaaatgtttcagattaaatgatagtaaaaacacctgacaactaaacatagtaagtaatactagactggattctgtaccagaggtaacataagtgctccaaaggacaatgttaggtcaactggcaaattggaatatagacagtcaatcagataagaagtatactttgattaagtaaaaaaaatccctattcttggaaaatacacaataaagtattttgaggtaacgggccataatgtatgcaatctactctcaaaaaattcagaaacatatatttgtgtgcatttgcatgtgcaacagtacacacaaacatacataaagagagcaattgataaggcaaataaggtaacatttaacaataatctgatacacataaatagagaaagagcaattgataaagtaaatgaggtaaaatttaacaataatctgagcaaaaggtatatgtgttttctttgagacagtctgattcttgcaacttattctgtaagttggaacttatttccaaacatgattgaaaaaaaaccccgcacttggcaacttcttctctttttcagcctagaaatgtctgtgttaagtggttttttatttattgttgttgtttgttgttattgttgttttgttgccaggctccaactcacaaaatacgagtttaaaaactgcgttgttatttttagagatttgtgataatacaacttgttataaaatttattcctcaataaatataatttctctactatgcaaaaa

SEQ ID NO: 78908 - DNA, 701 bp, Homo sapiens
acacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtaagaaatgctttttgttgttctgctgaaaagctcctttttaagaaagctacatgacattttcatctactacttttaacaggatactggggagttttgcaaggctgcagtacaatcctcttttaggattaatcttttgttgtgtcattcagataatttatttgaattttatttgtggtaatttttaatagaattaacttaaatgagagagctgcttaaatgcatggaatgcccactgatttcaagggcaatttcataccaagagaattttggttgcaggtccagaggagagaaagcttaaaagcatggtcaacccattttctggcttttctgagagctacgttcatagcaactgaagtgttcataaaataaggaattgaatatattgcaaatcctagaaaatctcaatttaaaaatttaagttttagctaaactaacagttttttctctctacctctaggttgtcctttattacacaatcatgtagatacagagagtttaaaaacaaaaatacttcctaaaatac

SEQ ID NO: 78909 - DNA, 2216 bp, Homo sapiens
acacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtgtggggttagccaccagaaaactgggaaatttggccaaacccactgtgatcatcagcaagaaaggagatattataactatacgaactgaaagtacctttaaaaatacagagatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcctcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtacaagactttttgtaaacataggagtccctttattttaaataaataactagtcatatcattaggtccagtaattgttgacaggcaggaacgggggaccattgcattgtgcccaagtaataataaaactatttcagatgtattatatgattgagcaaatgagaaaacatgttgatgttgatgggagtcaggatgttcactatggaaaaacaaatatacaaatatgaaatgagggaaggcaagaaagaaccatgtggaaatggaatagaattggtataaattcataatttctaaaccatgtatatgtacgtttatatgtattataattgcatacacatgcctccatgcatatatgtgtgtgataatacacatgcatttatgtgcgtgtgtgtatacacatgcatatatttactaatcctatctgccaaaatggcttagacacaaaaacacctcagcagaaatgaatatacctagcactcagatcttcgtgtctaatatagtttgccactaaaaggaaccaaggctacttggaaaaatggatgattccaaagcaagggcaaggtaggaacaagatgagcttgaaatatcttgttatgccagaaagtaatgttaaaaaaaaaaaatagaggtatattgccaaaacatagagccagcttgaaggggctcccactggccaaacttgagccaatctgagagcaaaataattgagaaaaataaataacaagataattgaga

SEQ ID NO: 78910 - DNA, 2880 bp, Homo sapiens
cgatcctcccacctcagcctcccaaagggctgagattacaggtgtgagcccccgaatccggtgtgcactgctgtttacttagtatttttctttaactagatttatttttaaacaaggctttgtccaaggacatttggctcgcaggcacagagctgattaactcgttatgtatcttttgataataaggcagcgatcattaagaaaaacgtgtagccaatgaaataacatgttctgggccccaccactggactgggaggtgcagcgcatccaagcagaggctgcctcctgccctccacgcctgctgctctcgcaggcaggggctctgctgcttacagcagtgcggccatctcggcttctctccacatcgtctgtcacgcgctggtccccaccatacctctcgccaccccgtgcctctgtccccgtgcggcctgaggagctccagctttccctgccagcggtgctctgggagtggggacgtgatgcagggcgagcatgatgcaacggggcaccccagacccttccctcccgtggggggaggggtgtggcacgcagaggggcagagggcggggacactggccccgtgggggaagaaggtgctgtcacagccgttactgtcccccgtgggaccccagcctggagccccccatcctttggctcctgcctgtggccactcagctctcaggtggccacatgcacatcccctgctccttccctgcgcacctgccctgcccagtggcctttctggtcccagctactgaaaccggtgagctgctccagggtgaggctgctttctggctcctggtgtatttggacacagataggcccttagtgtccagaggcgccccatgcagccctcatggtcagcaggacacccaggatagaccccctccacgcagcacctgggccctgggagcggctgcttttaggatgccacctgttcctgggcgccttgtttttagcttctgacctgaagatgagcgggggagcgcggtggcgagggcacgtgggcgtggctcacggtctcctctctgtggcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78911 - DNA, 912 bp, Homo sapiens
agagcaggaggatggggaggagagccccagcgacggcagccccatcgagctggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaaaaaaacaaaaagaaagacagacagagagcgagagagagagagagacagagaaagaggagcagcgaggacacagaggcgaggcggagagcagaagcggggccgacgcggacggacggcgccaacaaagaggagagacgagactcgacaaggagggggagacaaaggcaagagagcgcgagacaaggcaggagagagagcagagaaaagagagaggagacagagggagcaacaagaaagtaggagagaaaggagaggggagagccaggggaggacagaggggaggggaggcgcagggagggaaaagaagctcgcgcggaagagagagagaggcgggggaggaaaagagagagcgggggcaggggagcgagaagcggagagagagggcgacgcaggcgcgggcaaagaacaaaagggagaaccacagcaaacaaacaaacacacaacaaagcaggaaagcaaaacaacaaacaagacaccacaaaaagaagcagacaaagacagccaggcaag

SEQ ID NO: 78912 - DNA, 609 bp, Homo sapiens
gttgggtgcgggcatggtggttgcaggtgagtgttgggtgtaggcgtggtggtgtgtgcaggtgagtgttgggcgtaggcgtggtggttgcaggtgagtgttgggcatgggcgcggtgtgtgcaggtgagtgttgggcgcgggcgtggtggtgtgtgcaggtgagtgttgggcgcaggcgcggtggtttgtgcaggtgagtgtggtcctgttctgctcacccagcacatccctgtgtgtctctgtcccagtgggaagctgacggtgttcactgtgctgtgtgagcagtaccagccatccctccggcgggaccccatgtacaacgaggtgagagcttggggctggggagggaggaggggaccccacggtctgggtccaccccctctgagcccgctgcctgtgccttgcagtacctcgaccgcataggacagctgttcttcggcgtcccgcccaagcagacgtcttcctacgggggcctgctcggtaagccggggcgcccttgtcacacccactccagccctgggtcggtgtggggtcatcatctctgcccaggcaggtccagtgcggtccttcacgtggaagtggttttctgatcttttaaatgtttctc

SEQ ID NO: 78913 - DNA, 511 bp, Homo sapiens
caggccgggggccgtgaccatcggcagtgccccccagagcaggctcctcgtgcaggaatatgggtcactgccttccagggagtcctttttttcttctggtttctaagtcgccacctcttgctttacctcagatagaagcatccagaacgctgtagtatcggcaaagcagaagctggtgtggtgcttgctcagggtcggtgcatgcggttctgcccgtggccccactggcggcatcgtgaggccaggcgtgtctgggagcttgtttttccagagtgccctgtgccagacggctcccggcctcctctgagtcagtcatgtccctgcaggactggaactaggacggccggtcacagagtcagtggtcctgtcgaggctcctgctgtggtgttggggtacatgtcccagagcaagcacacggaggcccgggagctcatgtactcgggagccctgctcttcttcagccatggccagaaaacagtgcagcagacaacagacgacactacctggtacc

SEQ ID NO: 78914 - DNA, 706 bp, Homo sapiens
caggccgggggccgtgaccatcggcagtgccccccagagcaggctcctcgtgcaggaatatgggtcactgccttccagggagtcctttttttcttctggtttctaagtcgccacctcttgctttacctcagatagaagcatccagaacgctgtagtatcggcaaagcagaagctggtgtggtgcttgctcagggtcggtgcatgcggttctgcccgtggccccactggcggcatcgtgaggccaggcgtgtctgggagcttgtttttccagagtgccctgtgccagacggctcccggcctcctctgagtcagtcatgtccctgcaggactggaactaggacggccggtcacagagtcagtggtcctgtcgaggctcctgctgtggtgttggggtgggtctccctccagaaccttcactgtgcggggagcacagcaaaaccggaggcctgccaacggcctgcaggctgacgggggttgcgggggcactttctctcttgggtgcgggcttttccctcctggtgccctgcctctgtgcagcacgaagcggtctcctgtggggggagggcctgtgtgccaggctaatgagatgcccggatgtggcggggctgtctgtgtttggggtcctggctgtggtgccttctgaagaggagcccttttctgtggttaactgagatccaacccgttgcgttctcggctggccttcccg

SEQ ID NO: 78915 - DNA, 2094 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78916 - DNA, 2532 bp, Homo sapiens
  misc_feature (2118)..(2119): n is a, c, g, or t
  misc_feature (2123)..(2123): n is a, c, g, or t
  misc_feature (2130)..(2130): n is a, c, g, or t
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggcaaaaaaaaaaaaaaaaaaaaaaannaaanaaaaaanaaaaaaaaaaaaaaaaaaaaaaaaaaaaaaaaaaaaaaaaaaaaaaaaaaaaaaaaaaaaaaaaaaaaaaaaaaaaaaaaaagaagaggggcgggggcggcgcgagcagtacactcacacgcgcggggggaggcggggcacgaagagagagcgcgccgcgcgcgccccgcggtgttaacgagagagaggcgggggcgcggtcaagagggaggagggagcggaaatatacgatgcagagcagcggcggccgcgcgaccccgaactaaacaaaagacgaggagcaagaggagagaacgaggaagcgaagggaagagggacacgaccggcggagcggaggacacacaacaccgggaggggggggacaagagcaaagcgaggacgacacaaccctcacaggagtac

SEQ ID NO: 78917 - DNA, 2131 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggcagaagaaaaaccgaaaataaagaacaagtcgcatcga

SEQ ID NO: 78918 - DNA, 1703 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcaaccaaggcttggccggggttcaacccaaaaaggccagcgggttgccctttggggcccccttcggacctggaagaagccccaagcccaaggggcccccccattggtttgagtcctttggcaacattgggcgcgaacgcccgggcatcagcgttaatttctgggaaaaccaaccgagggggggtccacattttcctttggccaaggtttccaaggggaaacctggaaaacccggggttcccgcg

SEQ ID NO: 78919 - DNA, 1949 bp, Homo sapiens
  misc_feature (22)..(22): n is a, c, g, or t
  misc_feature (50)..(50): n is a, c, g, or t
gcgacccgaaccgggtgtaccnagcgttgtggagggcaagctgcgcccantcgtagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78920 - DNA, 1956 bp, Homo sapiens
  misc_feature (13)..(13): n is a, c, g, or t
  misc_feature (22)..(22): n is a, c, g, or t
  misc_feature (34)..(34): n is a, c, g, or t
  misc_feature (54)..(54): n is a, c, g, or t
  misc_feature (60)..(60): n is a, c, g, or t
gcgtctcgcaagnctcgtgcgntactcgagcgtngtggagggcaagctgcgcgncagtcngagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78921 - DNA, 2177 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgaggtgagagcttggggctggggagggaggaggggaccccacggtctgggtccaccccctctgagcccgctgcctgtgccttgcagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78922 - DNA, 2235 bp, Homo sapiens
caggccgggggccgtgaccatcggcagtgccccccagagcaggctcctcgtgcaggaatatgggtcactgccttccagggagtcctttttttcttctggtttctaagtcgccacctcttgctttacctcagatagaagcatccagaacgctgtagtatcggcaaagcagaagctggtgtggtgcttgctcagggtcggtgcatgcggttctgcccgtggccccactggcggcatcgtgaggccaggcgtgtctgggagcttgtttttccagagtgccctgtgccagacggctcccggcctcctctgagtcagtcatgtccctgcaggactggaactaggacggccggtcacagagtcagtggtcctgtcgaggctcctgctgtggtgttggggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78923 - DNA, 2029 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78924 - DNA, 1585 bp, Homo sapiens
gttgggtgcgggcatggtggttgcaggtgagtgttgggtgtaggcgtggtggtgtgtgcaggtgagtgttgggcgtaggcgtggtggttgcaggtgagtgttgggcatgggcgcggtgtgtgcaggtgagtgttgggcgcgggcgtggtggtgtgtgcaggtgagtgttgggcgcaggcgcggtggtttgtgcaggtgagtgtggtcctgttctgctcacccagcacatccctgtgtgtctctgtcccagtgggaagctgacggtgttcactgtgctgtgtgagcagtaccagccatccctccggcgggaccccatgtacaacgaggtgagagcttggggctggggagggaggaggggaccccacggtctgggtccaccccctctgagcccgctgcctgtgccttgcagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78925 - DNA, 1625 bp, Homo sapiens
agcgagaagggcgtcgggcggccgtcgggacggaagccgggaggcgctgccgaccgcgcctgcgacagcgtcagcccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78926 - DNA, 1499 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78927 - DNA, 1101 bp, Homo sapiens
aggagagccccatcctcctgctctgaggagcccatggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78928 - DNA, 1008 bp, Homo sapiens
attagaggatcgtgtctagcctgcaagtgggggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78929 - DNA, 208 bp, Homo sapiens
ctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggcgctgtgcaacgctggtcct

SEQ ID NO: 78930 - DNA, 1702 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78931 - DNA, 1417 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78932 - DNA, 1201 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgaggtgagagcttggggctggggagggaggaggggaccccacggtctgggtccaccccctctgagcccgctgcctgtgccttgcagtacctcgaccgcataggacagctgttcttcggcgtcccgcccaagcagacgtcttcctacgggggcctgctcggtaagccggggcgcccttgtcacacccactccagccctgggtcggtgtggggtcatcatctctgcccaggcaggtccagtgcggtccttcacgtggaagtggttttctgatcttttaaatgtttctc

SEQ ID NO: 78933 - DNA, 2285 bp, Homo sapiens
cgatcctcccacctcagcctcccaaagggctgagattacaggtgtgagcccccgaatccggtgtgcactgctgtttacttagtatttttctttaactagatttatttttaaacaaggctttgtccaaggacatttggctcgcaggcacagagctgattaactcgttatgtatcttttgataataaggcagcgatcattaagaaaaacgtgtagccaatgaaataacatgttctgggccccaccactggactgggaggtgcagcgcatccaagcagaggctgcctcctgccctccacgcctgctgctctcgcaggcaggggctctgctgcttacagcagtgcggccatctcggcttctctccacatcgtctgtcacgcgctggtccccaccatacctctcgccaccccgtgcctctgtccccgtgcggcctgaggagctccagctttccctgccagcggtgctctgggagtggggacgtgatgcagggcgagcatgatgcaacggggcaccccagacccttccctcccgtggggggaggggtgtggcacgcagaggggcagagggcggggacactggccccgtgggggaagaaggtgctgtcacagccgttactgtcccccgtgggaccccagcctggagccccccatcctttggctcctgcctgtggccactcagctctcaggtggccacatgcacatcccctgctccttccctgcgcacctgccctgcccagtggcctttctggtcccagctactgaaaccggtgagctgctccagggtgaggctgctttctggctcctggtgtatttggacacagataggcccttagtgtccagaggcgccccatgcagccctcatggtcagcaggacacccaggatagaccccctccacgcagcacctgggccctgggagcggctgcttttaggatgccacctgttcctgggcgccttgtttttagcttctgacctgaagatgagcgggggagcgcggtggcgagggcacgtgggcgtggctcacggtctcctctctgtggcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgacgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgggc

SEQ ID NO: 78934 - DNA, 1389 bp, Homo sapiens
agcgagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggggtgcgtcttgggatcctgcagggggagggggctgtgaatgtgcgggttgtgtgtagacgtggtgtggatagctgtgtgggtgtgtgtgcaagtgtagccatggtgtgggtagccgtgtgggtatatgcatagggtatgagtgctgggtgtagacgtggcataggtgtgtgtgcaggtctgttgggtgtagacatggtagtgcgggtagctgtgtgggtgtatgtgcaagtgtagacatggcgtgggggagtgtaggtgttgggcctctggtagtgtgggtgtgtgcaggtgtggggtggtgtgggtgcagacgtctggggggttgtgtgcgggtgttgggtatccatgtggtgtgggggtgtgtagacgtgtatacaggtgtgagtgcaggtgtagacggcgtatgtgcaggtgttgcgtgtctggtgtgggtagttggggtgcgtgcaggtatgtgtgttgtgtgtagacgtgtgggtagctgtgggggtgtgcaggtgtgtgtactgggtataacctgagcagccagggggatactctagatct

SEQ ID NO: 78935 - DNA, 5772 bp, Homo sapiens
ggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggcttggtgtctttcttttctaattatgcagaataagctctttattaggaattttttgtgaagctattaaatacttgagttaagtcttgtcagccaaaaaaaagt

SEQ ID NO: 78936 - DNA, 478 bp, Homo sapiens
gtaccgggccccccctcgagactagttctctctctcctcttaggagcttgaatgtaagaattcttaatttataactaatttgaaaagaaacttctcttttaaaattagttataaattaagaactcttaggagcttgaatgtaagaattttaagttggggctggggttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78937 - DNA, 536 bp, Homo sapiens
ttcctactcctaggttttccagcacggacccttgtgaccttggtcaaattgctgaacgtctcagaagatgctcttcatgccatagaatggagttgacgcctacctacctcttggtgctaaggctggaatgaggaaaggtaaccttttaaataacagttagaagagaacctagcacatagaaggaattcagttagtctacttctcttctccctgacccacagtctaccaaaaaactcgatctattctgagacccatgccctcagagtcctatcctctgtgaatgtgaccaccctagtaagttagtgcattacccctggctagaccctgggccaggagggtgctggggacagccctggatcacagttttccaaatggcctgcaagccctggctctcacagcaatgatgagaggtggctgagactgcaaaagtgaggacctcagattgctcccctttgcagtgactgcaggtcagaacagtttcatggggtcaggaatatgtatagtgacatcattcagatattttatgttcatgaaca

SEQ ID NO: 78938 - DNA, 5670 bp, Homo sapiens
ggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78939 - DNA, 5711 bp, Homo sapiens
ggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaaaaaaaaaaaaaaaaaaaaaaaaaaaaaaaaaaaaaaaaaaaaaaaaagagggacagcaaaagaatagagcggacgaacatcaacaacatgcagcgacacgctaatgatgatggggacaaagtggagtcccacgtgaaagaaacacacgtatatgacgactaagccagccgcagccacacatctatacaaaaaagcgaggacgaagcgagccgaaaccaaggaacatgtaagggacaaaccacgagtgacaagacgacaccaataagacatccagcgagagagggcacaacaccaaagaagggcgaccaacacgacactagcctgaagaaagaaatctagaacacccgagccaacgagagcagacaactaataggcaactttagggagtcggaccaaacgaggacgaccaaacacagaggcaaggcacaagagcatgaccgaagagacgacgaaacacatgcgcgtgcaggcctagagaatagacttgtcagaacgacacaacgtcgcgc

SEQ ID NO: 78940 - DNA, 6145 bp, Homo sapiens
ggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggtaagttcaccccaatatcaaaagaccttttgaaaaatagaacttaaaagcgaggaacacagtaacttgccatggttagcacatctttgatgtcaactgactgtcccttgtcagagagggatcttttatcattcattctctgtcctttttgcagcttacagttttccttctgagcttacacagaaggaagcttcctttaactgctttaaagatttctttttgacagttcgatggctgcatctttttagtagctcttcaataaatgaatacatttgatataaatcaaatgctgaagggttttttgtaaagtagaattttccccattgaatgattttagagctgtttgagaaagctctagctttttgcccctaagtatgtctgtcactcttaacatgttaagttgaattgattttaatttggctatattttcattgtgtgtgtatgtgtgtgtgcgtatgtatgtgttttttcctaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78941 - DNA, 5744 bp, Homo sapiens
ggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagcctggctctggtgtttctgctgaaacttggagagaccacctctggcccctttcaccatatatttgcagttgtggaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78942 - DNA, 5772 bp, Homo sapiens
ggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaaggaatgaaatggcttgggccataagaactgtttgttcgaccttttgaggaactgtcaaactgctgaaaagtggctgcaccattttacattcctaccatgaaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78943 - DNA, 5391 bp, Homo sapiens
ggcctggtagtcgcagcagccgctgccgcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78944 - DNA, 4654 bp, Homo sapiens
  misc_feature (149)..(149): n is a, c, g, or t
  misc_feature (151)..(151): n is a, c, g, or t
  misc_feature (161)..(161): n is a, c, g, or t
  misc_feature (167)..(167): n is a, c, g, or t
  misc_feature (171)..(172): n is a, c, g, or t
gacacaggggaaactgaaagtagagaaatgggtatcacaggagtacgcgtaacataaaagcatactgtaagatccagttagcagacataagcccaaataggctctgacgctgctagcagtcaaagagagaagggaaacatgatcagttntnagactgggtncatatnatannaactaatagctcagaagaatcagctaatggtataccctgcttgtgtgcacctggctagaccggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78945 - DNA, 4493 bp, Homo sapiens
  misc_feature (72)..(72): n is a, c, g, or t
acaaatgcatgggctgcgacgataacgttgtagatgtggtcgttacctagaaggttgcctggctagacccanggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78946 - DNA, 4658 bp, Homo sapiens
ctcccgggttcacgctattctcctgcctcagcctcctgagtagctgagactacaggcgcccaccaccacgcccggctaatttttttttgtatttttagtagagacgggatttcaccgtgttagccaggatggtctccatctcctgaccttgtgatccacccgcctcggcctcccaaagtgctaggattacaggcgtaagccactgcgcccggccacgtcttccttttcttagctttgggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78947 - DNA, 4569 bp, Homo sapiens
tattaattttgtccataagttatactttctcattccatgatacggctttcactctgtaaaactttgtccccaaaggaactttaaatctgttttgtgcctttttggcttgacagtattctttttccattacttttccaagtaccctgggggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78948 - DNA, 4623 bp, Homo sapiens
atgccccggtggttgaaggatggagttgtaaagggctcaactacagctgtggtaaaaccctggggcgctcgggtaaatagagaactccagcataggaacttcttgccataatcaactgagagacgttccatgagcagcgaggtgaacccagaaccagttcccccaccaaagctgtggaaaaccaagaagccctggctagaccggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78949 - DNA, 469 bp, Homo sapiens
tggttgagaagaggggccgcagagatgcagggggcatggtcagctgagccttgcatccagttggcagaggaggccaagaaagctgggagactgtgcacattccagggtcttagggcacccagaatcccactccttgggagcagacctctgaggaaagaggctgctgaatgaacaaggtgtagtggctgtgtgccctgtactgtgctgggggccagaagctataagacaaggcccttccttctggggagctcacagcgtttccctcgtctccttttccacgtgtcccacggactcccctgaacaccatcttactctgtgttgtagaggaggtgaatcaaaccatggctttctcatctgcagcctggctctggtgtttctgctgaaacttggagagaccacctctggcccctttcaccatatatttgcagttgtgggtttgtatctgtactacttctaagctcctatacat

SEQ ID NO: 78950 - DNA, 4664 bp, Homo sapiens
aaggaaatatgcaaaagaacatcacatcaaggatcaattaattaccatctattaattactatatgtgggtaattatgactatttcccaagcattctacgttgactgcttgagaagatgtttgtcctgcatggtggagagtggagaagggccaggattcttaggttgatctatctgtgggttatgacttcccacaatagccacccccggcccccaccagtccttttattggctctggctagaccggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggc

SEQ ID NO: 78951 - DNA, 989 bp, Homo sapiens
tgacgcccccgaacccagctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgagctttcttctgctttttgagattgtaagtttttcaaagatattttacttgggggtggaaaactgttagaaaattttaaagtattactaaacctcaaacaaatatttgtctatgatatccttttctgtgcaacatttaaattacatttaccctgg

SEQ ID NO: 78952 - DNA, 1769 bp, Homo sapiens
tgacgcccccgaacccagctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagagggtaagtgactggaaaggaccagtttgtccttggcacagtggaacacatataactaaacattttcactagacaagaataagcttcagtaaaatctccaaatggatatatgtttccgttattttataatggttactctatttacaaacttgaagtttgtttatgtacgatatgattttaactcaccctcttttttgaaaaagcaaattgttgaacctggcacttatttatgtgtgttcatgaacaaactactaatttttatatttttgcactaaaaagtaataagaattcatagtaaaattaatgagctttgggtagggaaactacaacagaagtgctgaatggctagtgggcaatattgtgtaagcataaatgttagatatatttaaggagcaattaagtcccatctgtagccaagaggcctagtagtgagaaaggaggctggctgcgataaaatgccttaatgcttccccccaaagtcacagatgctgttttaatgaattaagccaacatttcccttttattaacacaagttcagaaaaaagcattaaaatataaactcttgcttaaaagtggcaaatgaccaaaaggccaaattcactcatgcacacatataagtatgtaaagtagataaaccacagatgaga

SEQ ID NO: 78953 - DNA, 1511 bp, Homo sapiens
tgacgcccccgaacccagctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagagggtaagtgactggaaaggaccagtttgtccttggcacagtggaacacatataactaaacattttcactagacaagaataagcttcagtaaaatctccaaatggatatatgtttccgttattttataatggttactctatttacaaacttgaagtttgtttatgtacgatatgattttaactcaccctcttttttgaaaaagcaaattgttgaacctggcacttatttatgtgtgttcatgaacaaactactaatttttatatttttgcactaaaaagtaataagaattcatagtaaaattaatgagctttgggtagggaaactacaacagaagtgctgaatggctagtgggcaatattgtgtaagcataaatgttagatatatttaaggagcaattaagtcccatctgtagccaagaggcctagtagtgagaaaggaggctggctgcgataaaatgccttaatgcttccccccaaagtcacagatgctgttttaatgaattaagccaacatttcccttttattaacacaagttcagaaaaaagcattaaaatataaactcttgcttaaaagtggcaaatgaccaaaaggccaaattcactcatgcacacatataagtatgtaaagtagataaaccacagatgaga

SEQ ID NO: 78954 - DNA, 2010 bp, Homo sapiens
tgacgcccccgaacccagctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagaggttactggctgaccaacaaagttcctatcaaaagacccagcacaggtcttctcatgtatacacttgccacaagattctgtgatgaaattcacctgtatggattctggcccttccctaaggatttaaatggaaaagcggtcaaatatcattattatgatgacttaaaatataggtacttttccaatgcaagccctcacagaatgccattagaattcaaaacattaaatgtgctacataatagaggagctctaaaactgacaacaggaaagtgtgtaaagcaataaagcacattttgaaacaaacaatatgcacttcttttctgagatgcttccgaagatttgaaaataggatccaaaacacggctgggtttcagcatccaccaatgaactgaaaggtgaataaaggacgttcatgagaaatcgactaccagctgatgaaatacctgcaaagtgctctaaaaattaaatattttgactttaagggtcctagtaagtgccacttccactaagaatacagtttgaatgtataatcagtagtgtttacaagatccaacagtgcactcatcattagttaacaaagcaaatatgttcatcactgtcaggctgcccacagcaacaccaagcatattagaagaggaaccccaggaacgcaactcagaccttgggaaattaaaccatccttgtcagcagaagccaagatggaagcagtttgagcaatgaaatccgtaagattaaacaactcaagtaaatgcttcagtcaggactctgagtctgatcatgaattttatgttttaatttatgtttttttttttgtcttctggaatctcttttggtttggatattgggatgcttagaaatcctttctgagatgcatatgagtgaggaaa

SEQ ID NO: 78955 - DNA, 790 bp, Homo sapiens
tgacgcccccgaacccagctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcgggtaaatgcaaagcttcatttcaggatatgacaaaaagtcaagccataaatgaaatgtgaatatagagggtagagtgatggttaggatagcatgtgtgtttgtttgagcttgcgcgtggttagtgtcatgaattaaataacaaaggctgttgttgagatgtgcgtgcttctctaagctgttcccagtatgagttcaacttgctctgtgtggttgtggtgacagttgtgttggccctgggtgctctctcgccaaaggagaagtcactgcagaagtgtcaacaaagaacgtgtgtccttgtccttttaatctgtgggcagaactcaagagaaatgtctttattcaccaaacg

SEQ ID NO: 78956 - DNA, 599 bp, Homo sapiens
aaggcagtattgaccagacatttctatttcagagttggatttgtgcttagttttttttaggtgttgggacccttgtagttgctttttattttgcttagtcaacaaacactaaaatgataaaatttggtatgtataagtactggacgaaggatgttttgacactaaaaaggacataatttaggaaattaagaatttagacaccaagtttggcttaatagaaaaagtcactatctgaacttctttctttttcaccacaaatcaccgcagaccagtgtttgggagcaggtgtaggaaattgaattattggatctatgtttaggtaagaaaactaaaggtacttcagaatttaggctatgacataactgtctttctgaagtttaaagaaagaaagtgaactatagaaatctattcagctaattaaagtgaatgaaaaatattacagattccataactgcatggcgccttacctgctattaatactgccgccttactgtcagccagatgattttttcccaccacggccagtcttaaatttggcaataagaaaaagctaatcttccaagtgtaagtaggtatgtgttagaatcttggtgaaagat

SEQ ID NO: 78957 - DNA, 632 bp, Homo sapiens
tctttgcctctgaaaacactgaaaccataatgtgaagaagtttagattcatctgttgaagttagtgtagcccagctgacaagtacgaccccctaccagacatatgaggtggacatcttgcaccatccagtgccagtttgctacagaaatgaacctggatgagaccagtagaagaaccactcagttgagctcagcccaaatttctcatcagaaaatcatgagcaaatgcaatagttgttgttttaagccatgacagcttgaggtcatttattataaagtaatataaaactcattcattgatatattaatgaattatttcaagagaaaagtcaagtgatttctttcataggtgaaagaatattattttgttaatttatcctgaaactgtttgcctcttacaggcaactgcttaatgggggcaaataaataaacaaataaataaataaagcaaaaatatgtcttttttgtttagtagtcccaaagtatgaaaagctgaagatttatttaaaatatgaatatattctactaaagagataattttctcctttctttttacctgaaacagtcaagtaaagattccacttttctgccctttgttttttaggaacctccttttgttttgcttgttgacat

SEQ ID NO: 78958 - DNA, 655 bp, Homo sapiens
atagataagtttaaccaacatatacggaaccaaagaagccagacacaaaaatatgaatccatatccatagaagttcaaaaatgaacattttgggggattcatttataagaggtaaaatgaaaaaggaaatcacaatggtagtccctccagaagaacaggagggagttttgaaggagacaggctcatggactgctggccatgatcttttacgagctgggattggtaattatattggtatttatttttataattatttcaactaactatacaaatgtatgtatatgtactttcctgtgtgtgtgttatatttcataataaatgaagcaaaaatagtacaaaatcaaagatgtgtacacaaatattttgttataaagtattaactataactatgtttattatagggggaaaccccatactttgaatcactactttggattatgtaaaagaagggatcaaatacatcacgtggcacacagaagagaggttatacagcctctagaaattatagaagaatatttcatggcttctaaagataattgagatatatatttaggtgggagatgatgtttatcatacattatgcacaaatatttcaatgttttaaaacaaactttgaatgctaatgcatgaaaaaagattgggagaaacacattat

SEQ ID NO: 78959 - DNA, 332 bp, Homo sapiens
cagttcatggcacccaccaaactgcacaaggcagaaacaagagctctccattcctaactttctcttctgccttccatccatgtaatccgctagcccagctcattggctgcggaagcatctgagagtcatccactcccttccatctctgctgccaactccaggcctctgcccctcatctgaactgggactcagctgccctgtctctaagcatcctcactgcttcccacttaaccagccctagctctggggagcccatgaggtgacaccattgccctctgtacttcaaatgcacccaaattctcagcgacagctgccaggcctgacgcgtgtgg

SEQ ID NO: 78960 - DNA, 893 bp, Homo sapiens
ttaatagtgccctttgaacgtggctttggtggaattaagttaatcgtggtatagtatgcacctgaaggaatgtggagccgcatgctgggtctgcagaatgttgtcacctgatgaagaagaactggaagacgctggaagaaggctttggaaaaatgcccagatcatgagaaggtgagaggtgtttcttccgcctgctccaccagcaggtaaaggaggctgatcacaggctggcactcagggcgaggtggaagaaatgcgtggtcttgccactacagacccgcagagctgtcctccaacatgatccaagagagccacaaaacacaggggtgtgtcttgggaaaggaaaagtaacaacttgcaaaaaggttggttctgcttcagagaaatgttctagaaagacagccaagttaccctgccgtgaactcacacacacctgtgctttctgcatgttatgtttcataggagagggaagtgccgggaattaaaattgcggatgcactgttccccaggtgtgtgggtgaggcacgcttcctgggaccactccatttaagcattgggtcccaggcatgttcactactagcaggaggctctttatcaatttcctcccgtggaccagatgattgggatttttttttctaccagactttattacagaataactatttttgtattaactaagcaaacaaatgtaccgctcccagcttctgactggcccaaggtgctgagctagacctctttgctttggtacaaagagagcccaaagccaagagacttggcatttctgttagctggtattccccagggtgactaaaaggatgatttccattggatttttttaaatgctgaagacactgaaagacctgaatagtaagcccgtaataaacgttattcgg

SEQ ID NO: 78961 - DNA, 1230 bp, Homo sapiens
agaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgttcaaatagttaagcttaaccatgttgctgccaaagacttttcctatgcagtggtggggcaccttgatcatcatcattatcttgattggctgaaaa

SEQ ID NO: 78962 - DNA, 1357 bp, Homo sapiens
agaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgttcaaatagttaagcttaaccatgttgctgccaaagacttttcctatgcagtggtggggcaccttgatcatcatcattatcttgattggctgaaaa

SEQ ID NO: 78963 - DNA, 1025 bp, Homo sapiens
ggtgggggtggcgaaaggaagggcgggccctcaggtgacgcagattggccctccagagaaggggcggccccttctcaggtgccgtcacccccaaacctcagcactgccattccaggtccttaaaggggagaccgcgattctaagaagcagccaagcccagggctggcctgaagcccccggacggcagtgcccagcaggcagcgcccagcaccctggctcccacctcccagtggccccaaaggaaaacagctgccatgcacatccccaaaagcctccaggagctggccaacagcgaagccgtgcagtttctgagaaggcccaagaccatcacgcgggtcttcgaaggggtcttctccctgatcgtcatctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgttctctgggcagttgtctggttcatgggtttctgcttcctggccaaccaatggcagcattcgccgcccaaagagttcctcctggggagcagcagtgcccaggcagccatcgccttcaccttcttctccatccttgtctggatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaagtccccccggcttgctatgatgcctgacaactaaatatccttatccaaatcaataaagagagaatcctccctccagaagggtttctaaaaacagccctca

SEQ ID NO: 78964 - DNA, 419 bp, Homo sapiens
ggtgggggtggcgaaaggaagggcgggccctcaggtgacgcagattggccctccagagaaggggcggccccttctcaggtgccgtcacccccaaacctcagcactgccattccaggtccttaaaggggagaccgcgattctaagaagcagccaagcccagggctggcctgaagcccccggacggcagtgcccagcaggcagcgcccagcaccctggctcccacctcccagtggccccaaaggaaaacagctgccatgcacatccccaaaagcctgagttatgctagctctgccctgtccccctgtctgaccgctccaaagtccccccggcttgctatgatgcctgacaactaaatatccttatccaaatcaataaagagagaatcctccctccagaagggtttctaaaaacagccctca

SEQ ID NO: 78965 - DNA, 504 bp, Homo sapiens
gagttgtatttggtttgtggatgggggcggactcataaaataccaaacaacagacagcaacgtattactaaacgaagacgtctttttatgggtttctgcttcctggccaaccaatggcagcattcgccgcccaaagagttcctcctggggagcagcagtgcccaggcagccatcgccttcaccttcttctccatccttgtctggatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaagtccccccggcttgctatgatgcctgacaactaaatatccttatccaaatcaataaagagagaatcctccctccagaagggtttctaaaaacagccctca

SEQ ID NO: 78966 - DNA, 474 bp, Homo sapiens
agtgatccacttgcctcagcttcccaaagtgctgggattacaggcgttagccacctcgcctagcctaaaatcctgtgttaatgaatagaaatttaaaccgctgcatgaggccggcggctcctgtattagacagcgcaactctactccagcagctcactttagggaaggctaggagggactggggaatgacttgtgggagatgtgtcaacatagaagctaataaaaaaagtatttttcaatacctcgtggaagttcgtgcagcaagaccaccagccccatccttcccatgcctcagcagccctgcctgagtgagctttccccctgccccttttctctccctgtgacgccacagttctctgggcagttgtctggttcatgggtttctgcttcctggccaaccaatggcagcattcgccgcccaaagagttcctcctggggagcagcagtgcccaggcagccatcgccttcaccttc

SEQ ID NO: 78967 - DNA, 333 bp, Homo sapiens
ctgaccccaaagccattgcttcttctgttgtaagaagtcctgacaacatccatcttaaatttaaatgctctaccttcaaaacttttctccagaaatcacttaagtgcagtatcagagaccaaaacagattttgctatgattaactttgtacccatacttttaactcctgggcatatatcccttccttgatgtagaggatgctggtttcaggttaacacttatagatggcctgctctgtgcagaacattgccaacctctccaggtctggcacttaggcctgggcccacatgctcaatgaagccgctgctttgactatcaggtctagagaatact

SEQ ID NO: 78968 - DNA, 316 bp, Homo sapiens
ctcatgcagggtctgctcttctggtggtaactgacaggccatgaggtgaattagttgttaggaagtaaattggtacaattcctataggattctgaggctgcttaagaatctctctcctgagttgctgcccaaggcaatgagatgctaatgacatcacggctagaatgacagaagcagttcattaggcagcaaagaaatcaaatgcaagctaatcaaatcccagcttttggagacagcttaggatctacaggaaagaaggcttgatgtggggcaaatgaagcacagccaccctgaagcccaccaaaaccctgcattc

SEQ ID NO: 78969 - DNA, 250 bp, Homo sapiens
gtgcaatgttgtcacagatgtgtgccagattttgcagaggacataagttggctgtgaggaagaacacagaggttgcctattttttaggcaggaaagaaagcctgcacttttctgtgtgtgtgtgtcaataaatctgaataacaacttgaaagggttaaaaagctgagcaccaggtgttttctttccactttccagagtaatttaagcacactgcaaagttatctcccttccttccccacgagccagctta

SEQ ID NO: 78970 - DNA, 316 bp, Homo sapiens
taaaagcattttactttcaaattcttcattagacttccctctcatgggcctattaggacaatgaatgtcatttgaagtaacacagcaccttgttttctctccaccttctctttctttgtagtccctaactccttcccacccttctttctgttgttctcttcatttatccactctccttacaagaacttcaagaattacacaccaatgaagtgtctaaagcaaaagcaccagaggtggtacagttctttcttcagtgactgccttacggtgctctaaggatcacacgcttctaacactcagaggaataaaagacatc

SEQ ID NO: 78971 - DNA, 777 bp, Homo sapiens
cttaaatacactggtaacacaaggaaacaataatgactaagaatttccaagttcatatcagacaccaaaccacagatccataaaactcagataacattaagactgaggcccctaaaaacctaaaaataatttttaaaaatctaagcatatcatattcaagcttcagaaaatcaaaagcaaagaaagaaaatcttgaaagaaaccagaggcaaaaaacaccttgcctacagaagaccagcttctccttagaaacaatgcaaacaggagagtagaatgaaattaaactaaagtgttgagagaaaaaaaacatgaacctaaaaatttataccatgcccggctaattttttgtatttttagtagagacagggtttcaccatgttagccaggatggtctcgatctcctgacctcgtgatccacccgcctcggcctcccaaagtgctgggattacaggtgtgagccaccgtgcccagcctcctgttccttctttacatgtaagaagattaaaagtcaccactccatcctaacaagtaaaaagctaagcaaactgaaaaaccaatagctgtagttagatccttcagagaagtgaggtcacagggcaaaccacggttccccaaaattgagagacaggtaggcagatagagaaaaatctcaagtcatcagagcagaaacccacaagcagaaacttccttgggaaccagtgccagggtaagaaagcctcaactataatgacaaattgctggagactcagtgccaacaaatgacaattaaaaactcca

SEQ ID NO: 78972 - DNA, 4752 bp, Homo sapiens
acccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactggccaaacatcagtcatttgcttgagcatgcccaaatattacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 78973 - DNA, 4843 bp, Homo sapiens
acccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactgtctgggaaaaaaagaataaaaagtagtgtgagagcagaaaacgtgattgaaacacgaccaatctttcttcagtgccaaagggtggaaaagaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactggccaaacatcagtcatttgcttgagcatgcccaaatattacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 78974 - DNA, 4708 bp, Homo sapiens
acccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtgggttatcagctaacacccgcgagcatctataacataggccaactgacgccatccttcaaaaacaactaaaggatgatatgatgaacctagcctgttaatttcgtcttctcaattttaaactttggttgcttaagactgaagcaatcatggtgaacctgaggaatgcggtgcattcattccttgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatgattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactggccaaacatcagtcatttgcttgagcatgcccaaatattacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 78975 - DNA, 407 bp, Homo sapiens
gacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatggtaagtacaattttattcacttttcaatctcgtataatgtcataaatttgtgtcatagtaaacactcataaagttaattattttacttgtaacatttggaaaaagaaaaaagcaaatcgtgtgacagaaggagttggatgtatgtatcatatttattaaacaaatcagtaacagtcttccaaaagcaa

SEQ ID NO: 78976 - DNA, 423 bp, Homo sapiens
actccaactagtggcttggcaaaaaattagagatttttaatggggggctagcaggctataggaagggttgtaattggtacatggagaaaaaagagtacaaattgaatatttgaattttaaaaaaaagatgatcatgaaaaggcacaaaatgtgttgctgtttagtccaagtgtaacagcgttctagaattgtttctatggatctgaagacagattaagggcaagtgacttggcaaaaggcctagacctgttttcagataattatctcacagtagaaaaaaataagggcagtacaagctccagtgaggacactacaccaacatgacagatctaaatggaacatacttctatgagtcatttatagctttaaatactatagagaaaagaatgcataaaacatgcccaaacagcctctttttgatgt

SEQ ID NO: 78977 - DNA, 817 bp, Homo sapiens
aacataacttctagattgttttgtgcaatacttttttccgccatattctggttcctgtatacagtatatctgttcagtatcttaaaaattacaactgttttcatgattttgattgaagatttttttaactcagcccacccacttatggaagtaaagcagaaagggtctcaaagcaactcagaagcctcaggtgcatgatttaaaactcaacatatttatttaaagcagcatctgtcaggcccaaagctcacaacctccttttgggcattaaatttggcatgagccaccatgcccagccaatgtaactggtttctaagagtttagccacagtagcttctagagataggaaattagatttagtgggtgggaagaggccctgatgctggtctttccagagcttatagttgctaacacttttctttgtaaagaagtttaccttttgactggaaccagatggcactgagaaaaagaatgagaaccaccttattcttctgaaaaagactttcttctcatccagtaatttgggctaaaaaatggaaagatgttgatgacttgaagtgatgcaagaatggacaagtcagggaagtcattgggaacatggatgaggttgtaagcattggtacagtgtcctgtttcctgacttttttgagagaaatgtctacttttcctgttttctcttggggacttttgaccctagagtagccctggtgttatattttagatatcccaagctatatcagactttacctgaatatactggagttacttattatcccccattctataccccaataaactcagtttggggcttcttaag

SEQ ID NO: 78978 - DNA, 675 bp, Homo sapiens
ggtttctttctttttttgagatggagtcttgctctgttgcccaggctggagtgcagcggcatgatctcgactcactgcagcctccgcctcctgggttcaagtggttctcctgcctcagcctccctagtagctgggattacaggtgcacaccaccacacctggctaatttttgtatttttagcagacagggtttcaccatgttggccaggctcgtatcaaacccttgaccccaggtgatctgcctgcctcagcctcccaaagttctgggattacaggcatgagccaccatgcccagccaatgtaactggtttctaagagtttagccacagtagcttctagagataggaaattagatttagtgggtgggaagaggccctgatgctggtctttccagagcttatagttgctaacacttttctttgtaaagaagtttaccttttgactggaaccagatggcactgagaaaaagaatgagaaccaccttattcttctgaaaaagactttcttctcatccagtaatttgggctaaaaaatggaaagatgttgatgacttgaagtgatgcaagaatggacaagtcagggaagtcattgggaacatggatgaggttgtaagcattggtacagtgtcctgtttcctgacttttttgagagaaatgtctacttttcctgttttct

SEQ ID NO: 78979 - DNA, 468 bp, Homo sapiens
attcaagcactcattctatccacaactaacaaactgatatcagaaatattactgttaaacatttaaaaaattaaatgtgaatttatcttataaatttgtgaattcaaattttaaatttcaaatttttaactggaagtggtagcaatgaataacagattggatagcacagaaaatgacactgatgatttgaaagtccactttgaggagttccccaaaaaccaagaagcaaaagatagagatgaatataatatgtaaaatataagagatatgaggggtaggtttaggagataaaatagagtatagtaggaattttagaaagaaatacaataatcaatacatttggaatgtattaacacagcctgagcggaataagattttaagttaaatggatcctttctagaaaaagcattaccataaagatgattcactgttaatatcatttattgtatgattagatcaaaagagaaa

SEQ ID NO: 78980 - DNA, 864 bp, Homo sapiens
accctggctggatatagggcaaaggagagtttggttcagtgcggtaggcccagctgaagcaggaggatggctcctttgtgaaagtggctatgaagatgctgaaagctgatctcattgcctcaagtgacattgaagagttcctcaggaaagcagcttgcatgaaggagtttgaccatccacatgtggccaaacttgttggggtaagcctctgagcctctggagcagggctaaaggctgtcaccccatccccgtggtcatcttgcccttcatgaagcatggggacctgcacgccttcctgctcacctcctggcttggggagaacccctttaccctgatccggttcatggtggacattgcctgcagcatggagtacctgagctctcggaacttcatccaccgagacctggccgctcggaactgcatgctggcaggggacatgaccgtgtgtgtggctgactttggactctcctggaagatctacagcggggctactattgttagggctgtgcctccaaattgcccgtcaagtggctggccctggagagcctggctgacaacctgtatactgtgcacagtgatgtgtgggccttcggggtgaccatgtgggagatcatgacacgtgggcagacaccatacgctggcatcgaaaacactgagatttacaactacctcattggcgggaatcacctgaaacagcttccagagtgtatggaggacgttcttacactcccactccatccaagccaaggtctccttaggccttcagacgaccttttgtatgatctcatgtaccagtgctggagtgctgaccccaagcagcgcccaagctttacttgtctgcgaatggaactggagaacattctg

SEQ ID NO: 78981 - DNA, 1198 bp, Homo sapiens
tacttaaaaaaaaaaaaaaaacctagtgtctagatttatatcactagattgtttcattctaaggtttcagtttggacaaagcaacaacacctactgtctctggggctttgtttgtgatatcccaaattttgcatagaattgtaaaattgaaaaatctccttagaggtcatgttgtccaatgtacaataaaataaccttttagttacattcctaacaaatggttttctagtattttcttgaacacttccagcatcagattactacttagggatgcagcttattctgtattggacagcttgaatttagtttttattgtactgagctgtaactcctcagtagcttctaccagttgaacataggactgtgatcaagttcttttcaaatccttgtacttcattctataaaaataggaattttaaaaatcaaaggtggttttgctagatgtcagtgtgtgcaagtatggttgaaaagactagtgtgtaataagcgatcttctttattatccatataatttcttacaatttgcagcttagaccactgtggtatttgcatcttctttttggtaccatttttgagtttcctatctaatcttttacacttgttaacagaactattttctttttcatttctgtgctacacttagatgtaaatttgaatagtttgctttctttattttctaaaagcctaccccatcatgtaaattaatgcttgaatacggagcttggccaactttttctgtaaaggactagataaaatattttaggctttgtgggccaaaaggcaaaatcgaggatatcatataggtacttcagtaacaaaagagaaaacacattttcacaaatttttttattgatgaagttagaggtataataattgagtcttttttttatttttatttttaaatacagctctactaaccagaagaattgagttctttttggggaaatataacctttctcttaattgatgttcaaagttagtactttctaatcatcaaattgatggcaaatctgttaattcttagcttatgggcttcacacagacaatgggctgtagtttcctggtctctgctcttacacaaccattcagcatttctcctgtccctaggcttttatttgacgtacttgagctcaccatcaccatgctacaattctgtgggcatattagctattctatttgtcatatatgtttagctcat

SEQ ID NO: 78982 - DNA, 424 bp, Homo sapiens
agggagaaaaagtgtgtaaagagcaatgttctttggaaaaaccaattaattttcaaccatgaaaaaatgaaaacaggtaagtgctagaagtaaatgatggatgattattttcataatcttaggcagaaaaagtctttctaagaagttctaaattaaaactttgatatttaaaagattaaatatgtaatccttcaacatcaaaaacataaagataacaaaaattaaaagtaaatgaagatctgggaaaatatacttagaccatatatgataatgaagttagcactatcatatataatgatataataaagtcatatatcgtaatgtcattgtttctataacatataaagaaatgttataaatcaaggaaaagatgaacgccttaatataacgataagttaagaacatgaagcaatctgagagacaa

SEQ ID NO: 78983 - DNA, 1127 bp, Homo sapiens
gattctgcaaaagctgcccgaacaggctttcctctgaaaagcagtgccgttcctttttagaaagactgaatctaaatgttgtctctggagacaagaagccttcagtatgttaaattactttcattatgtattttcagatgcttattgattccacagtaggaagagtgagagactgcagcagcctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaactgtatcctaagaagatgctacataaaataaccacaaaaagaaaaacaatataactgtaaaagcctgaaaagaatttttaaaaggggaagtttatactttcatataccagaattgtggaagttactgattctggaagacataatgaaacatgaatttccaaaaagaaaagaaaatactttatcagcacacaaaaggaagatttaggaagtgttttctgcactaaatattcagatattcatatcaattggtatgactaatggatttttctatctgacttttatgaccaattatgtatcctcttctaatgaaaacaaacaaaattaaacagcagatggtttttatcaaaaggacatggcctggatttataatataaagcaagttatgtgatccaagaaaatcatttcaaaatagtgagcactgctattaaaaacagatttacaatggtaacaaaaggatgtctaaatatattttagaagctacaaacgttatgtttccttttttgttttcacatattctggaaaataaagaaatattatcatgtactccatcaaagggaaacat

SEQ ID NO: 78984 - DNA, 1011 bp, Homo sapiens
gcagtggagagaagcgacaagatgcttattgattccacagtaggaagagtgagagactgcagcagcctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagctaattcagtatttacaactgacaatatgaagaatgcaattgactgagcatctccctagctgtctgaactacgaactgcaagatgttcttgtaacacgactttaagacattaaggagttaaaaccagggaataggtctacattactgatggaatataaaaaatcaactgtatcctaagaagatgctacataaaataaccacaaaaagaaaaacaatataactgtaaaagcctgaaaagaatttttaaaaggggaagtttatactttcatataccagaattgtggaagttactgattctggaagacataatgaaacatgaatttccaaaaagaaaagaaaatactttatcagcacacaaaaggaagatttaggaagtgttttctgcactaaatattcagatattcatatcaattggtatgactaatggatttttctatctgacttttatgaccaattatgtatcctcttctaatgaaaacaaacaaaattaaacagcagatggtttttatcaaaaggacatggcctggatttataatataaagcaagttatgtgatccaagaaaatcatttcaaaatagtgagcactgctattaaaaacagatttacaatggtaacaaaaggatgtctaaatatattttagaagctacaaacgttatgtttccttttttgttttcacatattctggaaaataaagaaatattatcatgtactccatcaaagggaaacat

SEQ ID NO: 78985 - DNA, 2627 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78986 - DNA, 2167 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaatatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78987 - DNA, 1882 bp, Homo sapiens
gcggtggagggtccggccgctctcgaatgtccttcgctgggtgcagacaccggtacgtccggcgcgggtttttagtctcccaagcgagagcgtccgtcattcacccgcgtgggtctgcggtcgccctacgacccctaaggatgctggacacccttcgctgacctgtaccactacgcctgtcgctcagaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78988 - DNA, 3698 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcaggtgagggaggaaccgaggcatcccagaagcccttcaaggaacccaggccctgcaccacccactctgccccgaggcctggccaggtgacacttagccaccctgacctggcctcttcctgagagtccctctggacctgaacagggttttccagggcttctgctgctatgaagaattcttggggtggaggggttggttagccccatagaggggttgtggcagtaggttggggcctgggttagggagggagaggggtagaggcttgaggctaaagggagttactccccaacatacctccttgttctagcaagatgtccttccttcacgcgcaggttggagttagttgctcctcctggttcttgggtacaaagataccctcttctctgagactctcttttctcagtcttttcgccggtgtttggcagcaaaggatccgaggaggaagctgttggttgagcctccctgattctttggctcaatttggaattctttttctcccctagactcttcactgcctgaggacattccggtttttactgctgcagcagctgctaccccagttccatctgtagtcctaaccaggtatctgtgtcccctgactgcctgaggtgggtggaggaaggggttctggtttttggtccctcagtccttggacccaagctggtcaggcatgaggaagtctgagaataaacagaatggaatagttgggaaccagaacttgaagaaatcacagcagctggtaagctcttgggacaagaggtcatttgtgattttcagacagccttatgaatgatgtccgaccatgtttaagggtcttgcaggccccattttcttctgggttgaccacatgtcagttctgtgtttgaggcccatcaggcacttctgggactggaaatacagctcttctcccactgtcctggcttagatgatacccaagtgttccagaatggaaatgggctggggcctggagaaggcctcccttgagtgggagggggaaggaagccggctagagcaggaggagcaggctagatgtgtggacagacagctccccacccggtggaatcgggagatggtagtcaggaatctaaagtagtggttaggtttggagctcatgggcaggctcagatggaacccttcacctcaactttggccctgtgccttttccttcaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78989 - DNA, 2710 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcaggtgagggaggaaccgaggcatcccagaagcccttcaaggaacccaggccctgcaccacccactctgccccgaggcctggccagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78990 - DNA, 2582 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78991 - DNA, 1447 bp, Homo sapiens
gttcccggcgtgcaccggggcagtggctgctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78992 - DNA, 2646 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtttcagcagcgggtgaatatattctttacttttttttttttttttttttttttttttttt

SEQ ID NO: 78993 - DNA, 1533 bp, Homo sapiens
gttcccggcgtgcaccggggcagtggctgctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcagagtctgaggctcctgcgtggggaccagcgtgggtgtgagaagccttttttcactcagcctcatgcaccctgtgtctcccttccaaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78994 - DNA, 2382 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78995 - DNA, 2202 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78996 - DNA, 2462 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcaggtgagggaggaaccgaggcatcccagaagcccttcaaggaacccaggccctgcaccacccactctgccccgaggcctggccaggtgacacttagccaccctgacctggcctcttcctgagagtccctctggacctgaacagggttttccagggcttctgctgctatgaagaattcttggggtggaggggttggttagccccatagaggggttgtggcagtaggttggggcctgggttagggagggagaggggtagaggcttgaggctaaagggagttactccccaacatacctccttgttctagcaagatgtccttccttcacgcgcaggttggagttagttgctcctcctggttcttgggtacaaagataccctcttctctgagactctcttttctcagtcttttcgccggtgtttggcagcaaaggatccgaggaggaagctgttggttgagcctccctgattctttggctcaatttggaagttctcttaggggattgggaggtcaggaggacgtgggtcccccacccctctcttccccctatacatgggtgtgaatcaaaggcccccttcccctcgggaagttcttctttttctcccctagactcttcactgcctgaggacattccggtttttactgctgcagcagctgctaccccagttccatctgtagtcctaaccaggtatctgtgtcccctgactgcctgaggtgggtggaggaaggggttctggtttttggtccctcagtccttggacccaagctggtcaggcatgaggaagtctgagaataaacagaatggaatagttgggaaccagaacttgaagaaatcacagcagctggtaagctcttggacacgaatgatcaggtaccgagctgattcgtatcagct

SEQ ID NO: 78997 - DNA, 3215 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggtatctgtgtcccctgactgcctgaggtgggtggaggaaggggttctggtttttggtccctcagtccttggacccaagctggtcaggcatgaggaagtctgagaataaacagaatggaatagttgggaaccagaacttgaagaaatcacagcagctggtaagctcttgggacaagaggtcatttgtgattttcagacagccttatgaatgatgtccgaccatgtttaagggtcttgcaggccccattttcttctgggttgaccacatgtcagttctgtgtttgaggcccatcaggcacttctgggactggaaatacagctcttctcccactgtcctggcttagatgatacccaagtgttccagaatggaaatgggctggggcctggagaaggcctcccttgagtgggagggggaaggaagccggctagagcaggaggagcaggctagatgtgtggacagacagctccccacccggtggaatcgggagatggtagtcaggaatctaaagtagtggttaggtttggagctcatgggcaggctcagatggaacccttcacctcaactttggccctgtgccttttccttcaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78998 - DNA, 2499 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 78999 - DNA, 3214 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcaggtgagggaggaaccgaggcatcccagaagcccttcaaggaacccaggccctgcaccacccactctgccccgaggcctggccaggtgacacttagccaccctgacctggcctcttcctgagagtccctctggacctgaacagggttttccagggcttctgctgctatgaagaattcttggggtggaggggttggttagccccatagaggggttgtggcagtaggttggggcctgggttagggagggagaggggtagaggcttgaggctaaagggagttactccccaacatacctccttgttctagcaagatgtccttccttcacgcgcaggttggagttagttgctcctcctggttcttgggtacaaagataccctcttctctgagactctcttttctcagtcttttcgccggtgtttggcagcaaaggatccgaggaggaagctgttggttgagcctccctgattctttggctcaatttggaagttctcttaggggattgggaggtcaggaggacgtgggtcccccacccctctcttccccctatacatgggtgtgaatcaaaggcccccttcccctcgggaagttcttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 79000 - DNA, 2597 bp, Homo sapiens
  misc_feature (27)..(27): n is a, c, g, or t
gcagtgctggtactggtcccagtgttntgatggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcaggtgagggaggaaccgaggcatcccagaagcccttcaaggaacccaggccctgcaccacccactctgccccgaggcctggccaggtgacacttagccaccctgacctggcctcttcctgagagtccctctggacctgaacagggttttccagggcttctgctgctatgaagaattcttggggtggaggggttggttagccccatagaggggttgtggcagtaggttggggcctgggttagggagggagaggggtagaggcttgaggctaaagggagttactccccaacatacctccttgttctagcaagatgtccttccttcacgcgcaggttggagttagttgctcctcctggttcttgggtacaaagataccctcttctctgagactctcttttctcagtcttttcgccggtgtttggcagcaaaggatccgaggaggaagctgttggttgagcctccctgattctttggctcaatttggaattctttttctcccctagactcttcactgcctgaggacattccggtttttactgctgcagcagctgctaccccagttccatctgtagtcctaaccaggtatctgtgtcccctgactgcctgaggtgggtggaggaaggggttctggtttttggtccctcagtccttggacccaagctggtcaggcatgaggaagtctgagaataaacagaatggaatagttgggaaccagaacttgaagaaatcacagcagctggtaagctcttgggacaagaggtcatttgtgattttcagacagccttatgaatgatgtccgaccatgtttaagggtcttgcaggccccattttcttctgggttgaccacatgtcagttctgtgtttgaggcccatcaggcacttctgggactggaaatacagctcttctcccactgtcctggcttagatgatacccaagtgttccagaatggaaatgggctggggcctggagaaggcctcccttgagtgggagggggaaggaagccggctagagcaggaggagcaggctagatgtgtggacagacagctccccacccggtggaatcgggagatggtagtcaggaatctaaagtagtggttaggtttggagctcatgggcaggctcagatggaacccttcacctcaactttggccctgtgccttttccttcaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 79001 - DNA, 1097 bp, Homo sapiens
  misc_feature (34)..(34): n is a, c, g, or t
  misc_feature (61)..(61): n is a, c, g, or t
  misc_feature (71)..(71): n is a, c, g, or t
  misc_feature (76)..(76): n is a, c, g, or t
  misc_feature (80)..(80): n is a, c, g, or t
  misc_feature (92)..(92): n is a, c, g, or t
  misc_feature (108)..(108): n is a, c, g, or t
  misc_feature (130)..(130): n is a, c, g, or t
  misc_feature (133)..(133): n is a, c, g, or t
  misc_feature (161)..(161): n is a, c, g, or t
  misc_feature (195)..(197): n is a, c, g, or t
  misc_feature (199)..(201): n is a, c, g, or t
cgcgactgtaggccagcaaagagcagacagcgtnagtgcctaacactcaagggggagtgancgcctgagangagtntttnccctaatcttangctagacatccgtttnacgcgcgcgtgtacccagtccnttnagtctaccagagccccccatggacgcanccccttctcccctcagcattctaatgcaaccccnnncnnntctgcagggggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 79002 - DNA, 812 bp, Homo sapiens
gttttccccctggcctgttcaagagagccgttccgtaaaaatggggaggggccttttccaaaaattggcagaacgggataggggggccaaaattgtcgctttgggggacccgggtgcctttgacggccgggaaggcatgagaggggacccggatgtgaccccttcccccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 79003 - DNA, 2468 bp, Homo sapiens
tcattagaaccttttttttttttaatgtggtctctccctttctctctccaaggtcacaagatttccctcagcccagtggttgtgcaactttgggggaggaggcaatggggctctaggactaaacaatgcgcgtctgctcaacacccagatcagttgattaatcttaggcggccaaaattcacttttgctctcttcagctgagagacccaagactcatggaagagggaacaagaccaccaaggtgcctagtccttctaatcctgtcgtcccacattacagcctgattatcaggccccagaggtttcctcgccagttaaagagaggttcactagagcggttctaaaaaggtttcacaaaagaagcaacacctgaagggaggtgaaggacgacctaggaaaaggaagcaagttctgtgtcacggaggcccaagggcaaggggcttaggctgtgggttgaggggactgtctgagacggacttaaacctgcaccagctccagagccctgcggaaacagagatcggtcccctccggcgtctaggtaaggcccaccctcccagaccgcaaagagccaggatccgacggcagcctctccggaccaatcacaaccttccttcatcaaggaggcggggtcggggggggctgacttttccttgtctccgcccctttagtcgaagtaaccaatctcagtgcacctaggggaagtaatcgcaatgggagtaaccaatgacgccatgaagcttctcgtgcgtgcttgaccctgcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcagagtctgaggctcctgcgtggggaccagcgtgggtgtgagaagccttttttcactcagcctcatgcaccctgtgtctcccttccaaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttt

SEQ ID NO: 79004 - DNA, 579 bp, Homo sapiens
attttgtcctgtcttgtggatgttccatggcggacagacaggctgaacaaacaaagggtgtgcaaagaagcccagagcaggagagaaggctccccagcctggctcttggtcagcacagtcacaggctggctctgcctctcttggctgcactgtcctgaagcaggaaatatgagaaaaacaagtaaagggaaaacaagtccagttggagctatgataacattatctgcaaggccaggcaggggccccaaagaaatgggatccaagagcagggacgagaaaagcaagttcttagtctccccctggaattctttccccatgccatcattctttgttctgctcttataactatttttgtaactatttctgcaagtttgcaaggattttataagttcatgttttcccatctatgcaggatggcaaaggtcacaagacatgcctgaattgcaaaacctgtcacagtttgattaactgcctttgttctgcttctgtaagctcgctttccccaccccgcaagttttgcaccactggctagccactccccttcagtcgcctgaataaaagtcaagcctgatctttgtt

SEQ ID NO: 79005 - DNA, 763 bp, Homo sapiens
gaaaaagttcccacgtggtcaactggacaagcagggcaggcaaggccaagccagggctggccaagcccacccatctgcttcagggagttactgtgagtttagtatgtgtgtgcatttccactaaagaggctgacactaaaggtttgagacacacacatacagaacagtgggaaaacactgattttggagacaggtcaaatgctcaacacccccatttattggctgagaggccttgggagagtttcttaactcctctgagcctgtttcttcttcatgtgaataggagatctagtaatacccaacttgctaggttaatatgaggattgaacaaaatgtatacacctgtctagctcagagcccaggacacgtaaatactcaataaaagttaagaggataaagcagtgcatatgtggatgtaacagcagcatataaccccagtttaatactcatgtgagtctgaacaaaacactgagggaactcatctttgaggaatgagtggaatttctatctgtccacctccaggaaatctcctcttattgcctcagtgttctctccttcctctgagtttcagtagcacttaatgacttagcacaagtcacctggattatttatgagcttttaaatatacacttgtcagccgggcgcagtgactcatgcctgtaatcccagcactttaggaggcctaggcgggtggatcacttgaggtcgggagttggaaaccagcctgaccaacatggtaaaactccgtctctactaaaaatac

SEQ ID NO: 79006 - DNA, 456 bp, Homo sapiens
caaatgacccaacaccaagtatgaaggtgtctaaatgagaaacggttaggataaccttcttatatcaactacttcttttgtttctcctactcaagctgatgtttccacctcataaaacaatactaggttccctctatcatcacctacaggcctcctaccctccagaaagatgttaagtagaagatggtgctaaagcccatgggaactcatcaagttttataaattcttctcagagtcctcggaagtctcagcaggttctagtttagttcacaggccagtctactttgtaacaaaaagttgtttgctgttgctattgtttttaaaaggttagaggtgtaggactggaaaagacgtataccctgaaaatatttccaaaaatgttttagctagaaaagtgagtaacaacttggaatattaagagtatgtatttatgtgtgtgtatgtatgtgtttgcac

SEQ ID NO: 79007 - DNA, 330 bp, Homo sapiens
tctcccttctctggcctggctccatcccaaggcaagagagtaaaggttctctctttggaggaagggggcagtttgaggaaaaagagctccaaatcctgacactggctgggttccctctgtgttccacacggtgaagcccatcagtcaacaggtctcggcagtgcaccagaacattcagtcagcatttttgtgcctcattcttaaatggtacatacagaaggtcaagatttctggatatttgcagaatgcatccggcatgaaaaacagagaccaaaacaaacaaagaaaagggactcagagggaaaagaagcaatactcggaggaaaagac

SEQ ID NO: 79008 - DNA, 177 bp, Homo sapiens
gttggaagtagccctgggtttaattgctctgatgtcctaactaatgatgatcctaatattgaactcactgctgctcatcggagtcctagatctccatcaggtgggagaagtgggatttgttggcctacctttgcttcagctcataacatggcaccccgaaagccccatgcaggaatc

SEQ ID NO: 79009 - DNA, 253 bp, Homo sapiens
gccactccagccctcttccagccacatacccacaaagccaaggaatctatgcagaaatagaacatagggctccagagctggtggccccattcctagaccacagtttaaattcccaggattccagactaccttgcttgaatggctggctctaagctctcttccaggacttgggtaggattcttcctaggtccatcccccagggaagattgcctctagtgttttcaatcctaagagcaagatgtgccaaagccag

SEQ ID NO: 79010 - DNA, 398 bp, Homo sapiens
ggtttcggggtgaaatgcagggggttttagagataagcttgaggaggcggtgtctggtttacatggggcgtgcaagattggtcagatcaggtgtgttctttgcatgaggagtgagatactggttaggactaggtgtgccatttgcatagggcatgaatttctggcctcccccagcctacacttttattatgcagatgggttcgctgcctggctggtaccatgttgcccattcctttactgtacacgtggtaacaaaaaagggaagatggagcctccatgttggacatgcctggccaccaggtagctcttttctattggcgcagctgctgcattccctcatgcaagcttccggcttctctatgttcgcatttccatttttcaggctgctctttgttagg

SEQ ID NO: 79011 - DNA, 880 bp, Homo sapiens
ccagactataaattgggacagctgagcttgcagaatccagacaaccaaactccatcaatcaagaggaacttaatccagggttcttctgctcactgggtcagaagcatccgatttcctgtcatcggttgcggttcagccatgttaatactgaaagtataagaatatcataatcccagagtgatataaagacctttccaaggaagatgagatacccggaggctgtgaaggagaagtctgaaggatttgaacgcgttcaaatgaaaacctttggttcagcaaaacaccagaaacaaattcaaaagataaaatacactccggagaagcccattctctcaacgcatctgacagttcacaaagagcaactgcagtccaacttaaaaaataaagaaaatggtaggaaaatgggcaacatgcactgaggcaatatataagaagaaggaatgcgcaattaatcaacaaaagcctgctctttcctaacgagtgaagatacaagcttagtaaatattaaaatttattgaagataaaaatggacacttccggccatatataaaagcattgttggtaagagagtggggtaattgacatgctcctgggaaataatacgcattcagacaacctctaatgagtgaatccactgggggtatccactaggaatagaaaacgaccaccaatgcccaagtttgtggtccagaatttgagcagcgatctaacaaagtagagtctccccctgtgtcatgggccccacttcttaagcaaagaagaatgcctcattttggtaactcacccaaataaacagaaattttttttgataaacagagaatactcaagtaagcaaagagaaagagaaaaaagaaaaaaaagaggggggcgcgaaaaaccg

SEQ ID NO: 79012 - DNA, 380 bp, Homo sapiens
tatttgcccatttgttgattgcatgcaattaaggtagaattcacttttagataggtttttttaaatttaactctaacatgaatgctattgtttgaatgattacagcaattttatttggttctaaatggcttcattgttattttattaaggatgagagcgctcagatgtaatagttcttcagcaccatcttggaaaaaaaatttctcaaagcccaaagcttaaacactgtttttccacccacagatcttaccataatttctctagaataaaactagactgatgcagattttgtagtatattaaaaatagctcacgtgaatcattgtagaggccagaatatgtagagacttgagtattaatctaaagtaggaaaaggaaacc

SEQ ID NO: 79013 - DNA, 3954 bp, Homo sapiens
gcggtggcgcgggagcggccccggggaccccgcgctgctgacggcggcgaccgcggccggaggcgggcgcgggtctcggaggcggtcgcctcagcaccgccccacgggcggccccagcccctcccgcagccctcctccctcccgctcccttcccgccgcctcctccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79014 - DNA, 4345 bp, Homo sapiens
cattagatctttacatgaaagtaaaatttataagatttctagaaagtcaaaagatgataactatttcttaggatactaaaagcactcacattatagaaaaaaaatcagttaactatactccacaaacattaaaggctccctataaaaaaacatttttaataggcaagccacagaaagggcaaatattaatagtttgcaatacatatgtatgaaaaggaattgaatctagaatatttaacaaagctttacaactcaaaaaatacaaagaaaatatttttcttccaattggcaaattacttaaacagaaccttcacaaaagaagataagaatgtttaataaacatttgaagccataataatgacatcattagccatgatggaaatgcaaatttaagtaccacttcacatccacaagaaaaagataaaaataaaaggactgagctcaccaaacattggtgaggatgtggtaatactgaaattcttgtaccgtgctcctgagggtataacatattacaggatttttttgaaaactagtggttccttataaacttaatgccctggcaacctcacacctatttacttaagaatgaaagggccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcgggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79015 - DNA, 2429 bp, Homo sapiens
  misc_feature (1345)..(1345): n is a, c, g, or t
tagtacgtggatctctttgtactcttgccctgggcccccaaaatgtaagatgaagggctggttcatagtgccctaggctcccagttttctctgagcttcagaagctctagaactttggagtggcatgtaaacaggcacagtaagtggtaagtataccctaagagtttcgtaccaagtacaaaaggacaagagttttctggagtggttgagaaaggctttcaccaagaaagtgatatttgcactgagtcttaaaggatgagtaggcctttgctaggaagagcaggtcattccaagtgaaaggaacagcatttgcaaaggtatgaagatgtggaaccctgtgtattattggggtgggggcagatgggagggcgtgggttgcaagtgtttgctgatagaggaagcattcattcaagcacccataactatacccatcccatcttccatctctcacaggctctcccctacatcattagttttctgcttttctgtaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctaggtaagggatgcatagagcagagcgggtgggcagggctggagccgggaagggggccgtgttggctggagttctgaatggtgctggtagagatggaggttcaggcatcattcggcaaacatttactgcatataactacataccaccttgtaagtagttcttgtaggtggaacagataagcaaactggaaaagatcagataatgtggttgataaagagtgtccccaggtggttaaggaaaccccccctaaaaaggtctgaaggataaagatctgaaggatctgggatctgaacgataaagaagaagccatgtaaatatctgggggaaaatcactgccggaagaaggcacagcaagtgcaaagaccctatgacaggaacttgcttggcaattgcaaagaggctggcatagctgtgagaggggagtggtaaggggtgaggcagaaaggcagtaaccatggtgatgaagagcaacactgccgagctggggtgctgcctgtcctgcccattgcttacccctcccccagcacagtgggtgagagcagtcagagctgggaggtgaacccttccccagtttgtgcctctcagagctgtttagttcttgggagttgattccaaaggtctgcatggaattatgatggtgggaagggcaggggtcttagcaatcttctctctttggctncagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggtaagacagaaccctcccctctctccactctcctggagtataagccttcagggttctaaggcctttaagaatttcaaaatgattgtctttggtgggcctgggtctcccgcagccccagggaatcctttcctcctcaccctcctctgcaagctccacttctcaaaggattatgtctcctgttagggttgcatcctgtgtgcactttgtaaataaagcaggaagcacattcctgcttgagctgggggagggcacagataaggctttgtccccagctcagttcgctcccatcccccacctgtgcattccgggactgagccttgtttgtgttctggagaggcccctgcagccgggaacaggaatgtgattactcccagaaggttgtgttcctgcagcccctgaacccacagtgcccctatactcccatgttcccagctggacctttttctgtcctcaggccccagctggaggccttctccccaggctcactatggggtgggggcttttcctggctgcaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggtgaggcttgtaggtggagaggggcagaggctcaggggatcaaggttttcaagggcaacctagactgatgggaggagcctagtagcatctcccctcctagtagacccacagacagagtgaagaagttgaggccagggctgtttaaactatcttggctgggcatggtggctcatgcctgtaatcccaacattttgggaggttgagggatcgcttgaggccggcagtttgagaccagctctggcaacatagcaagactctgtctctacaaaaaaatt

SEQ ID NO: 79016 - DNA, 5139 bp, Homo sapiens
  misc_feature (4416)..(4416): n is a, c, g, or t
  misc_feature (4434)..(4434): n is a, c, g, or t
cattagatctttacatgaaagtaaaatttataagatttctagaaagtcaaaagatgataactatttcttaggatactaaaagcactcacattatagaaaaaaaatcagttaactatactccacaaacattaaaggctccctataaaaaaacatttttaataggcaagccacagaaagggcaaatattaatagtttgcaatacatatgtatgaaaaggaattgaatctagaatatttaacaaagctttacaactcaaaaaatacaaagaaaatatttttcttccaattggcaaattacttaaacagaaccttcacaaaagaagataagaatgtttaataaacatttgaagccataataatgacatcattagccatgatggaaatgcaaatttaagtaccacttcacatccacaagaaaaagataaaaataaaaggactgagctcaccaaacattggtgaggatgtggtaatactgaaattcttgtaccgtgctcctgagggtataacatattacaggatttttttgaaaactagtggttccttataaacttaatgccctggcaacctcacacctatttacttaagaatgaaagggccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaagaaaaaaaaaaaaaaaaaaaaaaaaaaaaaaaanaaaaaagggggggggggnaaaaaaaattccccgaggggggcccacaaatattaaggagagacccacagtataggtggcaaacaagcgggggccacaaaagagagggggcctactaaaaaacaatcagagagcaaggggcgcgagagaaaaaaaacaggctgcgcaacgctgaaaacggtgccaccggggcaactctgagagagagcacaccacaaacccgcggggcgggacacaaagcgggaccacacaaccagagacagcaaaaagagccaagggcacaaatcaaagaccaagagagcgcgacataggcggggttacaacaccacgcgcagaaacagccgcagcccccgtagaacaacgtcgggccacacagggcaatagtcatcgctcagcccctttttaacacggggaaaaatcacaatcacgacccccaaacacagaacgcgacacaccaacatagaaacaacaaaaacgagcaacaaagccagaaaaactccaaaaagcgccacaccccagagaaccagaaaccaagaaaaaaagagaaaaaacccaccagaaacaaacaaacagagaggagaacgcaaacacaagcaaacagacagcaaccccgcaccacaaaacagcaacaccaacaccgagcacaagccgacaggaaaacagaaaagagcaaaaaccaaagacaaagagacaaccaacaccaacgacacaaaaaaaaaaacgaag

SEQ ID NO: 79017 - DNA, 4899 bp, Homo sapiens
cattagatctttacatgaaagtaaaatttataagatttctagaaagtcaaaagatgataactatttcttaggatactaaaagcactcacattatagaaaaaaaatcagttaactatactccacaaacattaaaggctccctataaaaaaacatttttaataggcaagccacagaaagggcaaatattaatagtttgcaatacatatgtatgaaaaggaattgaatctagaatatttaacaaagctttacaactcaaaaaatacaaagaaaatatttttcttccaattggcaaattacttaaacagaaccttcacaaaagaagataagaatgtttaataaacatttgaagccataataatgacatcattagccatgatggaaatgcaaatttaagtaccacttcacatccacaagaaaaagataaaaataaaaggactgagctcaccaaacattggtgaggatgtggtaatactgaaattcttgtaccgtgctcctgagggtataacatattacaggatttttttgaaaactagtggttccttataaacttaatgccctggcaacctcacacctatttacttaagaatgaaagggccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggtaagacagaaccctcccctctctccactctcctggagtataagccttcagggttctaaggcctttaagaatttcaaaatgattgtctttggtgggcctgggtctcccgcagccccagggaatcctttcctcctcaccctcctctgcaagctccacttctcaaaggattatgtctcctgttagggttgcatcctgtgtgcactttgtaaataaagcaggaagcacattcctgcttgagctgggggagggcacagataaggctttgtccccagctcagttcgctcccatcccccacctgtgcattccgggactgagccttgtttgtgttctggagaggcccctgcagccgggaacaggaatgtgattactcccagaaggttgtgttcctgcagcccctgaacccacagtgcccctatactcccatgttcccagctggacctttttctgtcctcaggccccagctggaggccttctccccaggctcactatggggtgggggcttttcctggctgcaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79018 - DNA, 4239 bp, Homo sapiens
cattagatctttacatgaaagtaaaatttataagatttctagaaagtcaaaagatgataactatttcttaggatactaaaagcactcacattatagaaaaaaaatcagttaactatactccacaaacattaaaggctccctataaaaaaacatttttaataggcaagccacagaaagggcaaatattaatagtttgcaatacatatgtatgaaaaggaattgaatctagaatatttaacaaagctttacaactcaaaaaatacaaagaaaatatttttcttccaattggcaaattacttaaacagaaccttcacaaaagaagataagaatgtttaataaacatttgaagccataataatgacatcattagccatgatggaaatgcaaatttaagtaccacttcacatccacaagaaaaagataaaaataaaaggactgagctcaccaaacattggtgaggatgtggtaatactgaaattcttgtaccgtgctcctgagggtataacatattacaggatttttttgaaaactagtggttccttataaacttaatgccctggcaacctcacacctatttacttaagaatgaaagggccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79019 - DNA, 4632 bp, Homo sapiens
  misc_feature (1345)..(1345): n is a, c, g, or t
tagtacgtggatctctttgtactcttgccctgggcccccaaaatgtaagatgaagggctggttcatagtgccctaggctcccagttttctctgagcttcagaagctctagaactttggagtggcatgtaaacaggcacagtaagtggtaagtataccctaagagtttcgtaccaagtacaaaaggacaagagttttctggagtggttgagaaaggctttcaccaagaaagtgatatttgcactgagtcttaaaggatgagtaggcctttgctaggaagagcaggtcattccaagtgaaaggaacagcatttgcaaaggtatgaagatgtggaaccctgtgtattattggggtgggggcagatgggagggcgtgggttgcaagtgtttgctgatagaggaagcattcattcaagcacccataactatacccatcccatcttccatctctcacaggctctcccctacatcattagttttctgcttttctgtaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctaggtaagggatgcatagagcagagcgggtgggcagggctggagccgggaagggggccgtgttggctggagttctgaatggtgctggtagagatggaggttcaggcatcattcggcaaacatttactgcatataactacataccaccttgtaagtagttcttgtaggtggaacagataagcaaactggaaaagatcagataatgtggttgataaagagtgtccccaggtggttaaggaaaccccccctaaaaaggtctgaaggataaagatctgaaggatctgggatctgaacgataaagaagaagccatgtaaatatctgggggaaaatcactgccggaagaaggcacagcaagtgcaaagaccctatgacaggaacttgcttggcaattgcaaagaggctggcatagctgtgagaggggagtggtaaggggtgaggcagaaaggcagtaaccatggtgatgaagagcaacactgccgagctggggtgctgcctgtcctgcccattgcttacccctcccccagcacagtgggtgagagcagtcagagctgggaggtgaacccttccccagtttgtgcctctcagagctgtttagttcttgggagttgattccaaaggtctgcatggaattatgatggtgggaagggcaggggtcttagcaatcttctctctttggctncagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggtaagacagaaccctcccctctctccactctcctggagtataagccttcagggttctaaggcctttaagaatttcaaaatgattgtctttggtgggcctgggtctcccgcagccccagggaatcctttcctcctcaccctcctctgcaagctccacttctcaaaggattatgtctcctgttagggttgcatcctgtgtgcactttgtaaataaagcaggaagcacattcctgcttgagctgggggagggcacagataaggctttgtccccagctcagttcgctcccatcccccacctgtgcattccgggactgagccttgtttgtgttctggagaggcccctgcagccgggaacaggaatgtgattactcccagaaggttgtgttcctgcagcccctgaacccacagtgcccctatactcccatgttcccagctggacctttttctgtcctcaggccccagctggaggccttctccccaggctcactatggggtgggggcttttcctggctgcaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79020 - DNA, 2332 bp, Homo sapiens
gagtaacagagatccccgcggaagtgttatctgcggcaataattcagtcagaaaccacgcgtcgacgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79021 - DNA, 1738 bp, Homo sapiens
atcccacctcagccttccgagtagctgggactacaggcgtgtctaccaagcctggctaatttttgtattattatagagacagggttttgccatattgcccaggctggtctcgaactcctgggctcaaataataccccccttcggcctcccaaagtgttgagattacagatgcgagccgctgtgccccaccagggaataaaattttttaaaaccctagtgccatatgatgaaggggcccctgcttttgagggaagggctcctgccttttctcacgcttctctccaccccaggtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79022 - DNA, 4409 bp, Homo sapiens
cattagatctttacatgaaagtaaaatttataagatttctagaaagtcaaaagatgataactatttcttaggatactaaaagcactcacattatagaaaaaaaatcagttaactatactccacaaacattaaaggctccctataaaaaaacatttttaataggcaagccacagaaagggcaaatattaatagtttgcaatacatatgtatgaaaaggaattgaatctagaatatttaacaaagctttacaactcaaaaaatacaaagaaaatatttttcttccaattggcaaattacttaaacagaaccttcacaaaagaagataagaatgtttaataaacatttgaagccataataatgacatcattagccatgatggaaatgcaaatttaagtaccacttcacatccacaagaaaaagataaaaataaaaggactgagctcaccaaacattggtgaggatgtggtaatactgaaattcttgtaccgtgctcctgagggtataacatattacaggatttttttgaaaactagtggttccttataaacttaatgccctggcaacctcacacctatttacttaagaatgaaagggccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggtaagacagaaccctcccctctctccactctcctggagtataagccttcagggttctaaggcctttaagaatttcaaaatgattgtctttggtgggcctgggtctcccgcagccccagggaatcctttcctcctcaccctcctctgcaagctccacttctcaaaggattatgtctcctgttagggttgcatcctgtgtgcactttgtaaataaagcaggaagcacattcctgcttgagctgggggagggcacagataaggctttgtccccagctcagttcgctcccatcccccacctgtgcattccgggactgagccttgtttgtgttctggagaggcccctgcagccgggaacaggaatgtgattactcccagaaggttgtgttcctgcagcccctgaacccacagtgcccctatactcccatgttcccagctggacctttttctgtcctcaggccccagctggaggccttctccccaggctcactatggggtgggggcttttcctggctgcaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacatgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaaga

SEQ ID NO: 79023 - DNA, 820 bp, Homo sapiens
agcggtctggttagtgcaccaaacataatacaatatgccttcaatatgtcagcctgtttcatcctccctaaatacataattgattttcaacattttatgctccaattattgcccaaaagcagattggggcaagttcatatttcaaatactccttgcttaaaagtacaaaaagaatgaccagaacaattaatgaattgtcttcaatttttcttggaagagagtcatttgtttatgaccttctccaatttctccatcacacacatacatccccctaatatatcaaaaagaatacagaatttatataccctggctaaaaaatagagctacataaataccatgcaaaactaccaacaagaagagaagaatttttctttatttggaacaccgaaagagtagcctcctacatccccccacagaaacagaattaggaacaatgtcaaacaaaaattaaaagctcaaaattcccttttttaaaaaaagtagagctttatatttaggtcattttatttttaaccacagcctcctaaatgacctgaatatcccaacatccactctaagtgacaagttttgtaattcctctgaataatttagttgggcaaatttgttttactccttgttaaataaaaatgttacttcagaaattgacaagtcagttgccccacagaaattttcagtctcagtatcttccattcctattaggaaaaaactgtgtgagggaaagcacaactttaaaactgggtctcttgtgtggcagagacttcaaccgcacaatagagaggggcagtttcttgtttacctgaagtcttccatctatccacca

SEQ ID NO: 79024 - DNA, 475 bp, Homo sapiens
cctgcttaatattctcagttgtaattcttgttgttacaaacactttgaaattttaaattaaatttagctagaagtctttaagttccaactaatggctaatgtttgtagtaggtgcctttcagtagaatttgagggtggtgggaaaacctggcatttgaagcttccaacattctgagactgaggaggaataatcaagattaacagagtagaaccctcttaaataataccattgggacttgtaattgggcagttaactgaaaaagtcggttatagctgggactaataaaatgttaagacttaagcattttactttctttaaaacgtaaaactgcatttattcaccaatccttagatgtaaagctgccaagatcttttcttcgagtttagattgttgaatggtgttctcagagctctcacaaaaatcacacccttgatgcatgatgtatgatttcccattttgatttctttggagaaa

SEQ ID NO: 79025 - DNA, 350 bp, Homo sapiens
attcttattttttaagaaaggcattacgactgcttattattataaggtaaaggggaaattgaaggtcattgtacagatcacattagccagagggtacaatctcctgaaggcagtaacctcccctttattagggagaaagggggcatacatctaggaggcgcaggagcccttcatttctctactgagtaacacaggtctgagatgaaagccgagtgatggaatttgttcagaattctctggtttacctccctccactcttcaaattgtgccctcacccatctgtgcccaggagtggggccatgtcttcaatgagggtctcaccctagagccatttattccatctgagtcaa

SEQ ID NO: 79026 - DNA, 230 bp, Homo sapiens
gtcacgtaaatatctactacacacagtgtcaatccttaaggaccaaaatgaaacaaaacagaaatttttaagatataaatacattcaggatgtatcattattttcttcattgcttaagagattgggagaaaaaccattacatgtaaaattggaataataatgagatgcatcaccagtcatcaaatatgtttttgcccataaaataaaaccaaaacaaaattgactagata

SEQ ID NO: 79027 - DNA, 325 bp, Homo sapiens
aaattaaacattatcccaggtatgtatgtatggggaaaaacatacaatagctagggttcagaactctctatgcttctgggcatccactgttgtcttggaatgtatcccccaggatgagggtgaatgacagtaccatggattctattcatgtctccttaatccccacagtgaaccaagaatgcacctcccagtcactgactggctacagaaatcaatctccagggagaaatctgacaagtgacactgtgtggagtttcagttacagtgacacggcaatggaatacagtttgaaaggtacataaatagatttctctcctgcctagag

SEQ ID NO: 79028 - DNA, 562 bp, Homo sapiens
gtgaattgacattcccctgggagaacattttctgatattccagacatgattgggtctacctggtgtatgctctcataccttgcattttcctccagagcattttttcacagtctataatttcatatcaatagaatggctagttttaatctaatctataagacttataaacttggtaagggtagggatctcaattaatttgttcaccactgatttcctcattattcaatgtaacagtagtacatagtaggttcttcaagtgtttgttgagaataatgaggtggccgggcgtggtggctcacgcctgtaatcccagcactatgggaggctgaggcaggtggatcacgaggtcaggagttcaagaccagactggccaacatggtgaaaccctgtctctactaaaaatacaaaaattagctgggcgtggtggcgggcgcctgtaatcccagctattcaggaggctgaggcaggagaattgtttgaagccgggaggcgggggttgcagtgagccaagatcccaccactgcactccagcctgggtgacagagcaagactccatccccct

SEQ ID NO: 79029 - DNA, 736 bp, Homo sapiens
aaagaggaggtagacaggtcatcccactgaagtgagcaaagggctgaatggtctgagttgctgatgaagaaaactcatgaagagtttctgtaaaagcattcccaaatgtcctcatcaaagggaagggagtagatctaagggagggaagagtggcaaactctcccaacattttcctttattagtcgttccgtgttgaccaagggctcttatgaaacatgacatgtggttggccatggctatgctgcactctgaagagtggccatcctgccctttagatttgagccttttttctttctctgcattggtcgtgcatcaggttgttattgtcggggacaatcacaaaattactccattaggccaactacacatcttaaccaagccaaaaagatggccttacaaacacactgggttgccgcctggtgctgtgaccccatgagcattagtttcttcatatgtaaagtgagaattaaattaaatgagataatttttataatacaattagtatgtaattggcctttggtagattcttaatcatcagtaacattattattaccaacctatggtttttatcactaaatcagaatgtatttttgattatataaaaagctcttttggtggatgctaaaaaatgaaaactgactttgttttaagctatttcagatcatgtttatttgccctgtttgaaatccaaagctccaaatggttgaggacaaactcatcgctaatattgagattg

SEQ ID NO: 79030 - DNA, 539 bp, Homo sapiens
ttaaacatttctagaagcagttaacacctccaggtccttatttcatgccctggagcaatcacttattaaccacttcccaaatttcacagtttctgaaaattagctccgccagaatagagatttaatgttttcttcaaggattaaagagctcattaggaagtgatttttttctcactttcccattgatttttccgtttctgctgagaccattttgttatgcaggctaagagtaaagacgaagaatcctctctttcattcttaggttgccgcaagacagaagccaggcttgggtgagagttcaacacacatgggagctgaggcgagctgcacccgggttactgaacagccctgcaggaaatgcagtgtgctaggaccagggagagccccagttcctctgccagttctctatgttgtttcttccttagggaaaaactgtagtgttcattcctgtgggtgccctatattctaataacctcagtatttttatgatatttcagtgttcatcaagtacactctctttccctctcttggtatctttc

SEQ ID NO: 79031 - DNA, 922 bp, Homo sapiens
cgggccggccccgatacccagctccgcgccgcgcggacccaccgagcccgtgctcagacgccccagctccgccgagaagccgcttgagccgggtccttcttcttccccaagttcaggcagagcccgcggagccatggccagcccttccagcagctccgaagccactggcaagccccgaggcagggatggcagtcccaggatgggggaggaggacgtccctcccgaagagaagaggctggggctgtagctggaggggggaagcgcacagcccgaggactgcgaggacggggaggacccgccgctaccgggcaggaaggagaccggcacccagacaggtggcgacggcaaaggattcaggcagagcccgcggagccatggccagcccttccagcagctccgaaggccactggcaagccccgaggcagggatggcagtcccaggatgggggaggaggacgtccctccctgaagagaagaggctgggggcctgtagctggcaggggggaagcgcacagcccgaggactgcgaggacggggaggaacccgcgctgccaggcaggaaggagaccggcacccagacaggtggcgacggcaaaggagtaagtgatgcgggcgcgggggtccgggagtgccgggggctcgggggtgccggggacgcgacgaaggggcgtcgggaggctccgtggccgtccccgggttgaagttgggagtgcagccttcattctgaacccatttaggcagcatgggcagccctcctcgccatgggcaggatcagagcccccccgcccagtcttggggttgctcctggatgctgtctgggaggcttgctcatggtgacatcctcatctccccgtccacgttaccgcattcagagcttgggtcacctggacactgaactcaggtgaattttctctgagatcccg

SEQ ID NO: 79032 - DNA, 682 bp, Homo sapiens
tccagtttggccatgatacagggtctgtaaaagggagacatgagaaaagcctggaaagacctctctggtctgagaacaaactggtgaggatgctgttagtctggattctccccttagtgcatctgccaaggtgatatgatttctagaaacagagctttgaagcttctggggtagagaaagcctggccaggacctccaagggctcctgctggagaaggcttcaagataatcagtatctctattataactttggattccttgctctaaaaacagaggcaataataatagtatctgccttaaagcagttcacagaatttactgaaaggatgcctgacatgtggtaagaactcaatactggaaggatgcctgacatgtggtaagaactcaataaaagtttgcaaatataggccgggcgcagcggctcatgcctgtaatcctagcactttcggaggccaaggtgggtggatcacctgaggtcaggattttgagaccagcctggccaacatggtgaaaccctgtctctactaaaaatacaaaaattagttgtgcgtggtggcacgtgcctgtagtcccagctacatgggaggctgaggcaggagaattgcttgaatccgggaggcagaggttgcagtgagccgagatcatgccactgttctccagcgacagagtgagattccgtctca

SEQ ID NO: 79033 - DNA, 527 bp, Homo sapiens
ccagtgaccttgcacattccatcaatctttaataatatcattgtcattactcttattatcttaagtgttaaattgttgccagaatcaatacaagtctacttctttgaatatattttatcccagtgttgtttttaacatctttgttaagaggccaattaatttccaactcacagctccagtgaagtttatatataatgaggatttcctgactctttttcttttttccttcttttcttttttttttttttgcttatttctacttttgaaagaagacaaataaatggcatgtgaaaatgtgaaacaaacaacttgccatttaaaatgatatgaaattatttctaaactgatgaaaggaaaaaatatgccaaaaactgagacaaagcacattgaactaatacttgtttaatttctttttttatctgagcagcaggactaattttctcaaattcgatcagattgtatagcttagcaacccctccagggtcgccagaactagaggaatttctctaagcagaatctaaatgcct

SEQ ID NO: 79034 - DNA, 366 bp, Homo sapiens
aatgaactaaagatggtttgttgtgttggagaaatagagaatgtcagtaagatgaagtgtcatgaagatggcagaagaccatatgtgcccatcatccccttgcttaccaagtccttacaggaatttacaggagatactgtttcactgtgtgttgttttaaagagtaaatctccagtgatgctggaaaacaaggaagagtacacacatacacatacacacacacacacacacacacacacacacacacacacgtatgtttttgtttttgtgggtttgttttttttttgtttttttttagttttgttacaggccataaacttcaaaagactcaaagcagataggattgtatcgttgaggaaaaccaac

SEQ ID NO: 79035 - DNA, 212 bp, Homo sapiens
aatggaactatattagagctatgtttttatattttactggaacttactggaatatattttccagaattaatatgaatcagtacattgtgataaattaagacatatattttaacccctagataaatcactaagaaaataactccaaaaaatagttaaaacaaaaaacttataatagaacactataaaatatgtatttttaacacaaaagaaag

SEQ ID NO: 79036 - DNA, 408 bp, Homo sapiens
cgaaagcaactgcgatgattcttttatagtttattatagaataaaaaatccttttgaaagtaaaagaaagtgtacttaaatggcaactggtaacattgctgacacttttccaacctctacctcctgggttcaaatgattctcctgcctcagcctcccaagtagctgggattacaggcaaccgccaccacgcccagctaatttttgtatttttggtagagacggggtttcaccatggtggccaggttggtctcaaactcctgacctcgtgatccacctgctttggcctcccagagtgctaggattacaggcgtgagccactgtgcccggctgacacttttctatactgataggaatcttcatgatcagatgttgtcaaatacttttaaagtttatatataacattgtat

SEQ ID NO: 79037 - DNA, 272 bp, Homo sapiens
ttggatgctctggggggccgcctactactactactgctcgaattcaagcttctaacgatatacggggacatgctggttttttcatactattggttgtctctgtaatgcgagcagcttttgatctattaattaatgagatattaaaagtgatggtattctaaaaaaaatattccttcatttatgatctaaaatacctctaaataggaacttcctctcatctactttttgggggaagttaagaataaatgcctaactccttggtcttcaaaata

SEQ ID NO: 79038 - DNA, 1362 bp, Homo sapiens
aaaaacagccattactaatatctgcattagtctactcaggttgcaatcataatatgctaaagtagtaaacttttaaaaatgacagtaaacctgagtttattaacaggttacattctaaaagctaagctagtttggaaattggaaagcaaatgtgtgtagatattcatatgtccttgaccagactgggcctttctcttcccaggtaagtcattctctccaatggggccagttacttaaaattacatcagacaattgatagagcttctagatcccccttctaaaacaaaagcattttgccacaaactaggatggagtaggtttttttcagactatttatacttattttatgtatttcaatactgccctttaagtaaaagtactatatactttctctttttttagattaattctgcttaagtcagtcttttaatttattctagtttgagtttttaaaaaattttagaatgaaaaatctcaaaaatatactattatgtatatacactattttatatatatatatatatatatatagagagagagagagagagagagagaaagagagaataaagaacacctaggtaacccatcctccaccttcgacaattatcagctcctagctaatttgtgtcatctgtaaccccacctgcttctgccctttctgtattattttgaagcaaatcttatcatttatctgtaaatatttcaggactttaaaaaatatgtgtaatctgaataccatttttacacctaagaaaatggacaattccttaatataatgtgttgtctatagatgtcaaaaatttttgcagttttttggaatcaggaaccaagtaaggtactgaatattgcagttagctgatacacatcctaaatttcttcaattgttgtggtcctcaaactagagtgtatcagaatcactagagccttgttagaacacaaactgctgggccccaccccagagctggtgatctgtaagtctgctgtggagtctgggaatttgcatctctaacaaattcccaggtgatgctgaagctgcaggtttggggttcactcacctattggttcatcagcatctctctgccctcttacaatatatttgttgaagaagttgtgttgtttaccttgtagagtttttcttagtttggattttggtgatagcatgctggttttttcatactattggttgtctctgtaatgcgagcagcttttgatctattaattaatgagatattaaaagtgatggtattctaaaaaaaatattccttcatttatgatctaaaatacctctaaataggaacttcctctcatctactttttgggggaagttaagaataaatgcctaactccttggtcttcaaaata

SEQ ID NO: 79039 - DNA, 424 bp, Homo sapiens
gaatttttgctagtcttagcccccagttgtaaaataatgtcatgaaaacatttttatttcctaatgattataacaaagggaaaagatcttaaagagttgactttggtagtacaagtttgcgcaaatgattgatgattttttatttccttgatttgtgcattagcagcttttagtgtgtcatatcaagaggaatactggggaaataatataatgattgtttatatggagttctctactttcttgttttggcagtgtttgaaagttaggactgatcctgagggagttgaattttgtaaagttaattactttcctgctgccagtagtgatttatatctgtgatattatatcagctagtcatatgagaatgagaaacaaaattactttttctgcaattaccaactcactagtagggtattcaggtgtc

SEQ ID NO: 79040 - DNA, 475 bp, Homo sapiens
gcctctttatgaaattctttgagataatcttatagaggttagctgtaaccttgttccttgaaattctcttttggcactaggaacaggacaggcacatgagctgtgttttaggtttatttggagtatttaagatggattcagaagaaagcaacaaaacttacaagttaagattttattataactgcagttttctaatttagaagagaaacctggaagtaaatttaattatatttaattgtaattttctagtgtgcgtgtgtattttccataatttaaaaattattcttatttatttccttttgacaaacatatcagtttttaattctttggtgtttatttttatgtaaattattgacagcctgcattaagtgtttcagtagtgattttctaacaaccatacagtgttagtggcctgatgttcccttttttaatggaaggtgaatcacaaaatagggttaaaaactgtaacagaaaa

SEQ ID NO: 79041 - DNA, 879 bp, Homo sapiens
atttgttaaaaagaagtaaacatgttaatgaaacagaaaaaaagtaaattaatagaccaattcctggcaaagatgatgagaatgctaattcagtttaagagggagaaaataaatcatcatctctgggggcctacaattcagaaagacagtccagggcaggcgggcagactctgctccacgaagtcatccagagattgaaactagcaggtgctctgccattgtataaggcatcctttttttttggtctgcatggcagaaattaaatctctgaaacatttgtgttccagacaataggaggagaaagaaaggagggagcattacaaacaagatcttaagaccaatgttctggaagtgacatgtgtctcttctgctcatattccatcagtaagaacctgatttttggtgagaacacaggggactgagaaatgtaatatagctgggatgccatgtgcctggctggtagaagaaaggaaaaacatatttttgtggtctacttagcagtgtctctcacacctgctacagtggacctttataaattatgtaaaagtagtgtatatatggataaaactaaatatttcagtgacatgaagtgttctgagaaaatgtaaatgaaccaaattgaagaaaagagaagtagaaaatatgaaaagataataattctttccaacattgcctttgtctaaggcagttttactgctttactgctgtgtcttttaactttcaataagtagataaataccatattatagaaacttcttcagagcattataaaaaacaatttgccatcaattccttttgaaaaggtagaataatcctgatgctcaagcttgaaaaatataatacatcaaaggacattctagacccatctcattgagaata

SEQ ID NO: 79042 - DNA, 3493 bp, Homo sapiens
ggcttatagggctcgagcggccgcccgggcaggtatagaattcagcggccgctgaattctagggttttcaggagcccgagcgagggcgccgcttttgcgtccgggaggagccaaccgtggcgcaggcggcgcggggaggcgtcccagagtctcactctgccgcccaggctggactgcagtgacacaatctcggctgactgcaaccactgcctccagggttcaagcgattctcttgcctcagcctcccaagtagctgggattacagattgatgttcatgttcctggcactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacagaaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatctccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaacaccatgttctgtctcactaacctccaaatggaaaataatagatctagaaaattgcaactgcc

SEQ ID NO: 79043 - DNA, 3429 bp, Homo sapiens
ggcttatagggctcgagcggccgcccgggcaggtatagaattcagcggccgctgaattctagggttttcaggagcccgagcgagggcgccgcttttgcgtccgggaggagccaaccgtggcgcaggcggcgcggggaggcgtcccagagtctcactctgccgcccaggctggactgcagtgacacaatctcggctgactgcaaccactgcctccagggttcaagcgattctcttgcctcagcctcccaagtagctgggattacagattgatgttcatgttcctggcactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacagaaaaacaaaaagtcctttctcctgattcaccaaaaaataaaatactgactaccatcactgtgatgagattcctatagtctcaggaactgaagtctttaaacaaccagggaccctctgcccctagaataagaacatactagaagtcccttctgctaggacaacgaggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatctccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatca

SEQ ID NO: 79044 - DNA, 585 bp, Homo sapiens
ggcttatagggctcgagcggccgcccgggcaggtatagaattcagcggccgctgaattctagggttttcaggagcccgagcgagggcgccgcttttgcgtccgggaggagccaaccgtggcgcaggcggcgcggggaggcgtcccagagtctcactctgccgcccaggctggactgcagtgacacaatctcggctgactgcaaccactgcctccagggttcaagcgattctcttgcctcagcctcccaagtagctgggattacagattgatgttcatgttcctggcactactacaagattcatactcctgatgctactgacaacgtggcttctccacagtcaccaaaccagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacagagtatcagcgcctttgcttgctgctgtttttgctgttttttgatgctggga

SEQ ID NO: 79045 - DNA, 1735 bp, Homo sapiens
  misc_feature (191)..(191): n is a, c, g, or t
ctcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagnagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcaggtgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatgccgatgaaatgcttgaaaatgattctgctctcaaagttatgcttccctagaaaggtgtcatgtcgggcacttgtgttgggtgactatgacatcccagcagtgctggtcaggtctcagagttgctttcacctagagctgatgcttccacaaggggacatttgtgttactttgctccaggggtctgtcataaaaacaatggtaactacttcatccctaggaagcccaagacttcagggcactgttagctgattggtaaataagggacacgatattcacgggaattgtttactgctccccactagtaattctcatggggccacttttttaactctttctaattaacacctcttctcagcatagagcagaggatgcagtcatttctctgttgaaatctatgtagtatttatgtagaatgtcattatatgaaaagcgaattcagaatcctaactctgggaaagcgctctctggaaatgtagtttgataatagtgtcttataggggccacgggaatttgtttctctataaagcgatgggctccagtgtcatgttaccagagttatcgctcagttttgtttgttaaggcttttgctagaacctattatgtatccagtttttaaaacatacttcattcccttgatagcagagatccagagcacagatggcaagttgtgtggatgatactgaatatgtttattttcctaaagataaatgtcacgacacgacatttctcagtttttatttagatgtttattaccatgtgttaacagaatcttaaaacccaagggatttcttcagtaaactagactttgattcaacctgc

SEQ ID NO: 79046 - DNA, 916 bp, Homo sapiens
  misc_feature (191)..(191): n is a, c, g, or t
ctcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagnagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcaggtgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatg

SEQ ID NO: 79047 - DNA, 943 bp, Homo sapiens
  misc_feature (943)..(943): n is a, c, g, or t
aattggcaaggtaatggtctgaatcggacaatccttttgtttttacattgatgttttctatatttattttgtacctggaaaaatatttttacaatttattttgattttatatgtgtagaaaaatgtactgaacaatgttgacatgcttatttttgtaagagatgggtacttcttgttccccttggatttcggaagcaaagcaatgggaccctacgcttcagagtcttaatggggtggggcagtgtccattgaggtgtcctgtcgggaatgacaagtccagggcagattatgaggcaggcatcctttggagttcttctctcaggtatattttaactaaaagctatcatttaagttgaagaaatcaagtcttgtgaattgatacgattgtacttctagagtctttgatgataagttgtctttgggtactacgcttggctcctcgatctttcaaagtgtcatttaaatggaaataaatgtctgaaacagaaaaacaaaaaaacaaaaacaaaaaaaaaaactttttgtggcgcgcgcgcctgtggcgccctctcgagaagaagctttctttaagacaccacaatctcgtttgtgggcgggccgcgggcgccccaaattggggtttaagggttacacacaattgggtctcaaaaaacgaaggataccccatagggagaaaatctccttggggctacatgagaccatagtctcgtttagaggattttctttcccccaattatttaataaaaaaccgcccccggggagggaaaaaccgagagaacggcgtgtttcgtaggaacagaaactcccaaggaaattggggaggtttccggagaggggctcaatacacgggggaattactattttacagcagagaggagctttccaaacaggaggagctctcagcattatctacaagttttacccccccggcctagtggggagn

SEQ ID NO: 79048 - DNA, 487 bp, Homo sapiens
aattggcaaggtaatggtctgaatcggacaatccttttgtttttacattgatgttttctatatttattttgtacctggaaaaatatttttacaatttattttgattttatatgtgtagaaaaatgtactgaacaatgttgacatgcttatttttgtaagagatgggtacttcttgttccccttggatttcggaagcaaagcaatgggaccctacgcttcagagtcttaatggggtggggcagtgtccattgaggtgtcctgtcgggaatgacaagtccagggcagattatgaggcaggcatcctttggagttcttctctcaggtatattttaactaaaagctatcatttaagttgaagaaatcaagtcttgtgaattgatacgattgtacttctagagtctttgatgataagttgtctttgggtactacgcttggctcctcgatctttcaaagtgtcatttaaatggaaataaatgtctgaaacaga

SEQ ID NO: 79049 - DNA, 399 bp, Homo sapiens
  misc_feature (1)..(1): n is a, c, g, or t
ntgccaaagcgtagtacccaatatgtgtagaaaaatgtactgaacaatgttgacatgcttatttttgtaagagatgggtacttcttgttccccttggatttcggaagcaaagcaatgggaccctacgcttcagagtcttaatggggtggggcagtgtccattgaggtgtcctgtcgggaatgacaagtccagggcagattatgaggcaggcatcctttggagttcttctctcaggtatattttaactaaaagctatcatttaagttgaagaaatcaagtcttgtgaattgatacgattgtacttctagagtctttgatgataagttgtctttgggtactacgcttggctcctcgatctttcaaagtgtcatttaaatggaaataaatgtctgaaacaga

SEQ ID NO: 79050 - DNA, 855 bp, Homo sapiens
  misc_feature (1)..(1): n is a, c, g, or t
  misc_feature (855)..(855): n is a, c, g, or t
ntgccaaagcgtagtacccaatatgtgtagaaaaatgtactgaacaatgttgacatgcttatttttgtaagagatgggtacttcttgttccccttggatttcggaagcaaagcaatgggaccctacgcttcagagtcttaatggggtggggcagtgtccattgaggtgtcctgtcgggaatgacaagtccagggcagattatgaggcaggcatcctttggagttcttctctcaggtatattttaactaaaagctatcatttaagttgaagaaatcaagtcttgtgaattgatacgattgtacttctagagtctttgatgataagttgtctttgggtactacgcttggctcctcgatctttcaaagtgtcatttaaatggaaataaatgtctgaaacagaaaaacaaaaaaacaaaaacaaaaaaaaaaactttttgtggcgcgcgcgcctgtggcgccctctcgagaagaagctttctttaagacaccacaatctcgtttgtgggcgggccgcgggcgccccaaattggggtttaagggttacacacaattgggtctcaaaaaacgaaggataccccatagggagaaaatctccttggggctacatgagaccatagtctcgtttagaggattttctttcccccaattatttaataaaaaaccgcccccggggagggaaaaaccgagagaacggcgtgtttcgtaggaacagaaactcccaaggaaattggggaggtttccggagaggggctcaatacacgggggaattactattttacagcagagaggagctttccaaacaggaggagctctcagcattatctacaagttttacccccccggcctagtggggagn

SEQ ID NO: 79051 - DNA, 452 bp, Homo sapiens
agcctgcctcttgccctctttactaaaaaggcctttgcagaggctgcctgtgttctttctttctaggtctctctcatcctaggccctccagcttgattctgtggagctgccctcttgtcactcagtagcttgtggggtcttctctgtctagccacttaattgattgtgttcctcgagttgctgtccatggtctctcgttactgttttctctgtgtttctgcctctctccttggccttggtaggtccatcccctttgtgaccttggctgttgctctcatggacaactttctcttgctggtccttgtagtcctggcatccagcttctcgacacgggacttgtcctgccagtacctcagacttgcacttaaaattgaactagcaccactgtcactctccagggcctcttcttgttaattagatcattagggatgttcagaatcccagcatcatag

SEQ ID NO: 79052 - DNA, 618 bp, Homo sapiens
agcttccaactgtttatgagttacatctgtgttcttattttagtataattgtagtaaacttaatattcacactgaaagaaatagtaggaatatggctgatttcgaatggtaaacaaatcatacatattaatgttgctttgaaacatttttttgttgttgttttgagacggcgtcttcactctgttgcccaggctggagtgcagtggcactatcttgactcactgcaacctccacctcctgggttccagtgattctcctgctgcagcctccctagtagctaggaccacaggcacatgcccccacgcctggctaattttttaccttttttgtagagacagggcttcaccgtgttacgcaggatggtcttgatctcctgacctcgtgatctgcctgccttggcctcccaaagtgctgggattacaggcatgagccactgtgcctgtcaaaacatatatatatatatttttaagattttgtttgaatatggaaatagccaatctggggatttcccacagttacgaagcggggtgtgtgtgtgtgtgtgtgtcttaacataggggacttaggagttatctcatttctttaccattcccttaactaatctgttctggattaggc

SEQ ID NO: 79053 - DNA, 906 bp, Homo sapiens
agcggattattttgtctggccaaaccaatgtatcatttgaaaattatctgatttataaatttggtttactcacaaagtctactgcatatatgcccagtgaatttctgaaacaaaaaacacaaaatcatttggcagcatttattcctttggaagctatattttgggatctatttatatttttctgtaatgtttaatcatgccaaacaatatgatccattaatcatgtaggataatattaaaattccagtgtgtcattaaagttttacaaatgaatcaattaaagttatgaataattcagagatctaatatccacttagctgtcaatataaccaaatacaatcattcactgaaaattttttgctttgttctttgctgctcaaagtttggtctgtgagccataagtgccctggtcacctgggaacttgtttgaggtagaaaaccccaggcaccacctacatctcatgtaacaaaatccttagctgattcgtgcgcaccttaacatttgagaagggcttcctagggatatataaagatataccatacaaatgttgcaaatttatggtcaaaaaggatcaggatcagggaagaaaatttgtttattttttaatcccttatttcttagcttgtaaaacatattttctagagaaaaatgtgtctcttcaaggcaactggatattttgatgcaagatccctgactttaaaactttgggattgtcagaggcactgaaaccagagtgactctatcttgaataggtgctgggtaaaatgaggctgagacctgctgggctgcattcccaggtgaggcatttttaggcacaggatgtttacaattcagggaacagattcgtaatatttacccaatagacccaggacttgtaacagacccagcaaaagtcctgatgtccc

SEQ ID NO: 79054 - DNA, 399 bp, Homo sapiens
agagttaagttcctctaatgctagaaagaaaggtaatttttaaaattgagattgaagttatagtttttttgtgattaatttatttgtgagaattcctttgggccccttcaaatcaaatttagaaagagttcatgtctttccttatgttgaaaagatctcaggatctttcatttgagaattttagtctctgatctgaaatgtggcctagactagtacttttcatgctatgtgtgagagagctctagggttctacagaggtgctgtgtagcttcctcatttgtgcttttatctatttcatatattgaatttttgtaaaaaattttgtttgggagtacaaagttctgctatctaaaaaaagaaagtttgaaaaatattgagcattttatagttagtagcaga

SEQ ID NO: 79055 - DNA, 463 bp, Homo sapiens
tcgagaaaattgttgtcagataattctctgtagatctctctcatttctgcatatcttgaatgcacaggtactaattgacctttgttctggagcaaagagcagccatgtatgctgtttagaataatgaataagttgtctgtctgtggcaaagatcaggcctgctgactcccggttttgaaagacttgggttccataagctcaggaatcctctcctgtagaatgtgttcaagcatttatctgggcacttcttggaaacaaaggaaactggcaaatatgcagatgctcatgcttcttgctttgtttaaagaggaaaactgaagcattgtctctaaaagttggaaacatatggttaaagtacaggtgacttcagtgatgccacacactggccacacactaaggagaaagggtctgagggaagaggaagaaagtcaccactgaggaagtgaagaaggagttgccatct

SEQ ID NO: 79056 - DNA, 844 bp, Homo sapiens
aaaaaaaaaaaaaaaaaaagactagagaatgtcagggaacacatgtgtatatttaaacaacttcactttgcatttaaaaactcgaaggacagcgaaggtgaaatcaattcacgggccacctagactttccagtctaggactagagctgtagcaatgatctgttgtgctgtacaagaaaagagaaagaggtgttcatttgagaacagatgtttttatacatcagagtaaaagctgtattgaagagcaggctgaatcccttccatatagaatgaaatatgagcttgaccccagtccttatcttcagttacctccataccaactggtggcatgttggatttagcatgtagaataatttcccatctcttatttttcccaaggttaatggcatccttctggtacctggcttacatgtgaactgaattttgatctgggttctattttgaatttttctccttcagagacctaagtaggcaacatgaaagacaagtagttaagaaagaaaaaatgatgtttcatacacacaggctaccaacgagagttttctatgtaaaacatttagagtgtattctgatttaaaatgagaataacttcaaggtagatattatagtatttatgtagtttgcaaaagaagtttacatttttttgctattgtgatataacatttatgtgcaagaactacttgtaataaaaggatttgagatgtcatgcttctaaatataatagcctaaaatagagaatattatgatttgaaagtgtagatttcacaaactctgtatagtatgtgggtctatctgaagcttttatcgaagctacctataaaataaaattttaaaagatctgttct

SEQ ID NO: 79057 - DNA, 462 bp, Homo sapiens
caaagtgaagttgtttaaatatacacatgtgaactgaattttgatctgggttctattttgaatttttctccttcagagacctaagtaggcaacatgaaagacaagtagttaagaaagaaaaaatgatgtttcatacacacaggctaccaacgagagttttctatgtaaaacatttagagtgtattctgatttaaaatgagaataacttcaaggtagatattatagtatttatgtagtttgcaaaagaagtttacatttttttgctattgtgatataacatttatgtgcaagaactacttgtaataaaaggatttgagatgtcatgcttctaaatataatagcctaaaatagagaatattatgatttgaaagtgtagatttcacaaactctgtatagtatgtgggtctatctgaagcttttatcgaagctacctataaaataaaattttaaaagatctgttct

SEQ ID NO: 79058 - DNA, 376 bp, Homo sapiens
gacagggtcagggagtcaaggtggggccctacaggtcacctcctggcccacagcccctccctggccatgtcagcccctaactccccaggcagttgtgggtgtgggtggcaggtcagcatttcgagctttgccctcctgccactgcctgtcctggccactcatcagagcctgtcctctggaaaacaagacaaaggacgtgatttcacaagtgcctgggccagaatctcaaattcaggattaagaaaaagaaggattggctgggcacggtggctcctgcctataatcccagcactttgggaggccgaggtgggtggatcatgaggtcaggagtttgagaccagcctgaccaacatggtgaaacctcatctctactaaa

SEQ ID NO: 79059 - DNA, 1787 bp, Homo sapiens
acttaaacggaatggaacggaacgggaggccccggctggtgggcaggtcgcctgctgctgatacaggaagggacaaagggctcggacgattccggtctttccttagctgctctccttgcaagctctttcctccccatgggtctcttgatgagtccaacaagacgggcatggagcccgatctcacagatggggaagctgaggccagcggcagcttcccccagcacagaagagagctcctggcattccagcagggggtgactggaagaaaaccagggacctggtctaaccacctcactcttcagatggggaatagctggagatacaggaaatggcagagtacgatttctgcactggaggtttccccaggtgcccctgctggttggtggggaacacaggagccacgaccatccccacgagttggctgtcagttttatggattcccagaatatttaacagctgagtggatggcactggtcaaggccggcctgttccctcccacatctacccacaaggtatcttcctgggaagcagggaagacagtgtaggccctgccccgccagtgcatgagtgtctgggagtcaggactcctgtgtttgggtggccctgactccagtttgctctgtggccccaggcaagccactcaccctctctgggccatccatcaaacaagagataagatgctctccaggggctagcccttccttcggaccgtgagaaaaatctagggagggcacaggcatccatccatgaggacaggatggaggagggactacctaaacccctgtccatctctgacccccaagaggcctgtgaggcagtgggggcagcgcctggcccagccaccatcctctaggcagggtgctgccgtgggaagagagcactgtggtgaggtggtgagaccgcgtgccccgggtcaccctgaccggtccaattgcctgtcactcaccagaggcccaatcttgggcaagtgactcagcctcttggtgtgcgaaatggcccccatgaggcctcctcagcctggggggctccatggcagaagggttccaagaaggcaggagctggagctgttcttgccgctgctgggaggtcctgtccaccctctagcctccctctccctgatcccccaccactgcccattcccagtaaggcacctattctctttgccaccctgacaccaagtcactgttcagcttgtgggcaacagagccggaagcatggaaaaatctcatgctgctcccaaagccaagggagggctcaaagaaggctggtggaaaaaggcccagagctgtggccggacagagtaggccccgaacaaccacagagccgccttgacagaagccagggcacggtcctgagatgagcctcatccctggagggcagcaatggaccatacacgtgtctaagcccccatcaccagccggggacccagtgactcagagcctgctcttcctgaacccactcggcaggaagaaaactgaaggcccaagagccccagccacactgtgacctggaggtgacctggagggagacagggtgacagcaccaagctcagcctttcctccgaggcttcgcaggactgaatgaaggcaaacttcccaacaccccaagccatgggattgtccttcctggggccctgactgagctgtgacgggctgtgtggccctgggtgagttacttgccttccctgaggctcatctcagcacatataatagaaaatggagacaaaaggatgccctttgcatgggttttgggaaagattaagtcacatgtttataaaagtgcctggc

SEQ ID NO: 79060 - DNA, 744 bp, Homo sapiens
aggttacatgttatgctgcccaaaacaaagtcaacacagccttcggctgggctgcgaactcctgtttgaactgtgattactgttccttcttctatcagaaggcaacacttgcactgtgggaatggccatcaccagtgagggagaaatggaaggcaaaggaaagtcctttccagaaaagccccagctccctaagtcccaaatacccattcttcaggttctcagatgggaagcaggcatccacgcactcgcctcactggggaggggagtgtgtgggacacagtcgtccttgcttggtcaaggaaaaactcaacttctcaacatgcagctccatgttccaaaaggagcaagactgtctgtgctttgaggttcacatgaaaggaagtggaacaattgcccagtaaaggactcccatggagccaaagcacattctcaccaaaaagagggatattttagccagagtgggataaagatcaagggtgcaaaagtaaacttcagatataaggaggtagagaaaacacaaaggtggaacaaggatttctgtccaggtggtcaagctctcttcctctggggtcagcgtacagtggtattctctgctaatgacacctggatgcagcactcgcagtgagcatggtgttcagaaggtacggaccctacctctatcgttcaggaagcccccaggtgacagtgacacacacccacatctgaatatcactgggacagagcacacaaagctgtaactggtgg

SEQ ID NO: 79061 - DNA, 322 bp, Homo sapiens
catgtaatccagatacttgggagggtggggcaggggaattgcttcacccgggagcggaggttgcagtggcgcgatttcagcttactgcaacctctgtctccccggctgaagtcacaggggaatattttaaatcagggagccagagaaggccactctgacaggtgacatttgagatgagaccagaaggatgagaatgagccaactatgcaaagaaccagggagggctggtcaaagtgcagtggtgtttacaagtaattgaccacaatcagctacagatttctttgttccttcccactcccactgcttcacttgacttgcccta

SEQ ID NO: 79062 - DNA, 570 bp, Homo sapiens
atgtggtatatacatacaccagaatattacttagcctggaaaaggaaggaaattccaacatatgccacaacatggatgaatcttggagaaattatgctaagcgaaataagccaatcacaaaaagacaaatactatatgattctgctaatacaaagtacatagagtagtcaagacctagagacagaaagtagaatagtggttgccaggggctacagagaggaggaaatggggcattgtttaatggatatagtgttttaattttacagaatgaaaagggttctggaggctgggtacagtggcttagagctgttatcgcagcactttgggaggccgaggtgggcagatcacttgaggtcaggagttcaagaccagcctggccaacatggtgaaacccatctctactaaaaatacaaaaaattagccaggtgtggttgcgcacacctgtagtcccagctacttgggaggctgaagcaggagaatcgcttgaacctgggagatggaagttgcagtgagccgagatcgtgccactgcactccagcctgggcaacagagggagactctgtctcaaaa

SEQ ID NO: 79063 - DNA, 476 bp, Homo sapiens
aaccccagctactgggaaggctgaggcgggagattgcttaaggcaggatttccaggttgcagtgagctgtgatcaagccactgcattctcacctggatgacagagccagtctctaaacaaaaataaagaaaaaagagaaaccaataatgatgataaatagcagtgaggagttaaaattcagattatgtaataatgtacatttattttactgatttttttccccatattaaaaaccctttgggctttacttaattttccttaatcaccatgtttcaaattacaccagtagtcctctgattataatgaagatgaatcagtttcttattttcagatgcgtcaagtgttgccaagacattgcattcctccaccacctcaccagccattcccattttccactttaaggattatagccacatttaattgtgtctgtctgcttccttacctggcctgggacctggagagtaaaaaggtagttt

SEQ ID NO: 79064 - DNA, 647 bp, Homo sapiens
aaaagctttaattctttatatagcctttaactcacccttccaggaacttaaaatgttttatttttttcttgagacaatgtctcactgtgtcacccaggctggagtgcagtggtgcgaacatggctcactgcagcctggatctcctgggctcaagcaatcctcccacctcaacctcccacatagctgagactataggcgcacattgtcatgctcagctacttttagtatttttattttcttgtagagacgggggtcttgctgtgttgcccgagctggtctcgaactcctggcctcaagcaatcttcccacctcagcctcccaaaatgttgtaaaaattgtggagatttccccaacttatggccaagatggattaaccctcttgccttaaatacctacaaaaccgtacaacacatacgcaaaggcagtttttagacaccggtcaataggtggcactaaagaccgtgatctctgttaggggagaaaccaatgaggcaaagtgtttccagctgctgcgggaggagggcagccgagcagagcccagtggtctccctgagtgcaggagacagagctgaaagtgtgagcaggcctggccaggtgcagtggttcacgcctgtaatcctagcaccttgggaggccgaggtgggtgg

SEQ ID NO: 79065 - DNA, 163 bp, Homo sapiens
ctaaatcttttcatgtgatatacaattatggtgcaaaccaaaatgctgtaaaaatgttacatagtaccctcacataatagaagaaagcaaaccatagatataaaactgcaaatttgcaatggtagaacaaactgtattattgagtaaaaattagcttggtgag

SEQ ID NO: 79066 - DNA, 436 bp, Homo sapiens
gtttctgctccctctgctatgagcaatgaggttctctctgaccaagcctccagaagagcagaaataagatgcctgagtgctgcgtttgatgcagagagaaaccatttgcagataatgctttcactcagaggattttttttcacctcaaaatttgcattcaaaagctctaccaaggaaggcaaatgtgccagagattatggaacatctgctctgacactggcattactgcagtgacgagggctccctggagtaggggtgacaggagccagatgatgctcctgaggagatttgctgatttcaaaagaggcatctgtgaaaacctagtaagaatataaggaatgtgcttgaacagatggtatgtgtagaacattggaatagaatcattctctgaatcttttaaggattaataaatgtgatgaaggaaaaggattgcaaa

SEQ ID NO: 79067 - DNA, 167 bp, Homo sapiens
agagtagaactgatcttaggatgtaattttctagtaagatcacactacaatatttatgtcatacagatttgttttatttatgaccctgagaatgaacatccttatgggaattcatttaaaaatgttttaaataatgccttttcttcataaatcagggtctgattaga

SEQ ID NO: 79068 - DNA, 270 bp, Homo sapiens
tctaccttaaagtttgctgattctttcttctgtcacctcaaatctactgttgagtttagtaaacttttttgtcttggttattgtaactttccactccataatttctatgtaactgtatgttgacctactcacaacttgatattatatatttattttcattcagagaattatacattttgggtaagaattagcacttttaaattacatgattaaagatatagaaaatgcttctgttaaaccaaaacttctggaataataatacaatgtatt

SEQ ID NO: 79069 - DNA, 806 bp, Homo sapiens
cggggcgagatccgcgcccgggaaggcggaggggggcggcaggcccttctctgacaccctcgacgagcgaccgccgcaggggcataggccacccctgcccacctcggcctggcccgctcgaaggttccgcgttcccgccttgcgcccctccctccgtctagggtccacgccaccccggctgagagctgagttcggctctctagggtcccagcctggcgggtccatcccacccccctgggccttcagcccaggtcctggagaccagaggctcgaaaaccccgccaggactccgggcttctgaccacgggccgcgcggaacctcttctggactcatctgccagtcgcctaacagcatagacccccacccccaacaatcccccggggcttggcgatgaaacgggctggcgggctccctgcagacccgagcactgctgcactttttcctggagctgggtttcggacacttgccagactggggtgtctcccttctctgggctacacgtaattttggttcttttaaagtaaacagcgagatggaaatgtctggtcaccaagagacagggaccagttaactggtatttttcaaatggccctgaatgaatacacaaaccagctttcatctgcaatcagcatcccctcttcctgctgccctccgctggggagagttccttgcctggggtccaagctgatctgcagcctcagtatttacaggcactccagcatttcccctgaagctgagcaggcaaggcgggtctggggcctagcgcccacctacctgacagtgtgtatcaggccagggggaaccc

SEQ ID NO: 79070 - DNA, 697 bp, Homo sapiens
agagaagaaaagaaatgcccaaataagttgtacagtttggaagagcatgaatccaaaaagaactctgtagatgagaaaagcaagtaatctaagcacaggtgaaactagaactcaggtacctgggcttctagacctatactctttccacaataacattacctaaagaggcatgtcatttcacaaagaaaaacactacacagatttctcagaaacttaaaaaacaaaacactattcattctctttcacaaaacggcactgtatgaagaataatttaaaaccaattggaattaaagtttttttaaaaaaaacttaatagtatcctactacgaatctagtgccagaaaactctgcaacgttattataggtctatcactctcttgatactttattattatactgattatcttccttaataccaataagccctaacttaagaataatatctaatttattctagaaaaatcaaaaaataaattagcaatccctttgaaagcaacaataatcagctttaccggcatcaagcaagaagtcctcatcaagcatcacttgtcattaagctcaaagtgttggtcaagatgttataaacaatagctaacagtggttaatgtttcatttacactgttccattctttaacacgcctaaaaatagaggccaagtgaaaagcaactaacttgagcttaatttatttagggatat

SEQ ID NO: 79071 - DNA, 517 bp, Homo sapiens
tccatatatagagccaacaaaatgtggcatgattttttagcatttattgaagtgcaggaaaggagaatctattttaacattcttctttagtacaatgaatatgacattgatactgagaaggaaatgttggctctgcagaaaacagaaattacatagtaaagtctatgtattggtcttaaacttttgaaataaatcaatctataaaaaagtaaggaagacttattgagggttacagaacagaatataaatgccatatatcttgaaaacataaaagtgacagtacttttaacagaatatggaagaaggaaataaggaaaagaagtaaatgataagaacaccgatatccacatcttcgaagtggggaatcaacagatactgtctgtaccttatggaacaagaaataaagattaaagtatttgcttaaagttattaaggtaatcaagagagaagctaaaaatagggatataactctatggcagtgtaagggaacttaatccccacctctcataatgaagct

SEQ ID NO: 79072 - DNA, 386 bp, Homo sapiens
gatgctattttatttgttgcttgcaaaggggaaggtgatcaaaattcttttgacttatttaaaaacatctatatattttggccacgttttaaagattaaacaagtgttttaaatggcacatgatagttgttattacatccaacatatctaggctgttaaaaacatcttattgtatgacatatattgtaaatgttaaagaaaagtaactatcaccatatgcttacagttgcatgaggatgatacccttgataccttagcctctgaaaaggtataaaaaaaggtaaaaattgtaaaaaagaaatatattaataaacattgatacattattttgaaattgacaatctgaaacaatgatataaacaaatttgattttgcttggcacttct

SEQ ID NO: 79073 - DNA, 4101 bp, Homo sapiens
  misc_feature (2028)..(2028): n is a, c, g, or t
  misc_feature (2134)..(2134): n is a, c, g, or t
  misc_feature (2615)..(2615): n is a, c, g, or t
  misc_feature (2625)..(2625): n is a, c, g, or t
  misc_feature (2633)..(2633): n is a, c, g, or t
  misc_feature (2642)..(2642): n is a, c, g, or t
  misc_feature (2655)..(2655): n is a, c, g, or t
  misc_feature (2660)..(2660): n is a, c, g, or t
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactggggacattcgtctcggccttcactgtgctgtgcggggcccgcaccgacctcccggacaggcatgtgtgctgcgtcttctggctgaacattgcagcagccctcatccaaatcctcactgccatcgtcatggtgggctggatcatgagcatcttctggggcatggacatggtcatccttgccatttcccaaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctntgaagggcttgtttgtctatcagagactgtcagaactccatgagggcaggagaagggattttgcaggatgaaagtgcttgggaagtagtggccaccgttctggggntttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacnggtctcaggngggggccncccccacanatgggaggcggangcttnttttccccgcttgggctgggggcggctgctgagggggtgaagaagagatggcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattgccatctcttctccatcccctcagcagccg

SEQ ID NO: 79074 - DNA, 3700 bp, Homo sapiens
  misc_feature (1627)..(1627): n is a, c, g, or t
  misc_feature (1733)..(1733): n is a, c, g, or t
  misc_feature (2214)..(2214): n is a, c, g, or t
  misc_feature (2224)..(2224): n is a, c, g, or t
  misc_feature (2232)..(2232): n is a, c, g, or t
  misc_feature (2241)..(2241): n is a, c, g, or t
  misc_feature (2254)..(2254): n is a, c, g, or t
  misc_feature (2259)..(2259): n is a, c, g, or t
ctctgttttcaggctgtgttttctcttcttctctctctcctcttcctcctgctgcctcccactctgtgctgctgcagtttcccaagtttcccaaggctacaaggagcagggcatcccacagcagctgtgagcccacgggagccgctggggagatccaggggggccctgtgagggctgcaccaggcagctttgggcacaaggacctttacatgttcttttctgccattttctggactgggggtggaaagggggtatttttaaaaatattatttattttgaaaacgcatctgcttttctcagcaggttgtgagggctgccagcccctcctgctctggaaagcactgtgggcgcaggcaccagagcatcagagagtggggtggagatgagaacgcccacagagaggctgggatgctccggcaggctccaactggccttgctgtacccactgcccaccgcaaaggcacgccacgtctgctgggccgggccacaccgggccctgtctgggtgagcaggggctcaccaaggggacaggactgtggtagacccgtcctgtgggaccccacctgcctcaaaatctggtgccccgagtgtttactgtgtggtctcctgggggcagcaccagggtgtgggtgaggatggccaggctccaccctagcgtggaaaggcccactgtgcccacagctggcctgaggcctcggggagaagaccagtcccacaggcgtctcctgggcctgcctccctgaccgcaccccccgcctcctcgcagctgaaatctgagggctgggtgtgtcgtgacctgtgttttcctgggaaggagaggagtagctccttccctggggtgaaactgccagatgtttatacacaaagttattagactgaagcaggagtgggcagactagcaggctttcacccaatacttaacagcatttctggcccacattcctttttctgaagtcattggggccagatgtgtctccgaattgagaaattttagatttgagaaagacaatgcgatccatttatcgtacactttctaacttcccggcagagtgtggaacatctcgcctaccatcaggcacgtgaatatttctgcagagaaacatgtgactagtcccattaactgggagctatacaaactgtaaatagcctcacctcagttcagtctaattttgccactaagtaacttagggaaaaacttaccatttgagagcttttagggtttcagaattgcaagaacaattgtatggggttgtggaccttgatctgaaaatcctgcttgcaaacagatgtgttagagggtgaaattgtcggcattacacaaggactccttcagttgccaaaagaccatgggcctctttaaggagcccctctgtaagtgattgggacagggctagatccctaatgggggctaggggtggggagaatctagcagaagttgtccaggatactgtggatcaagtatcaatctgaaattaagagaaattagatactaagaggatggacatttacatgtctgtttcctttcctttcattttcattctaacataggaaatgctaacagatggggctggcccaaagtcaagcttctgactccacttgacacagtgccattgggcatgtccctctntgaagggcttgtttgtctatcagagactgtcagaactccatgagggcaggagaagggattttgcaggatgaaagtgcttgggaagtagtggccaccgttctggggntttcagcccacctaccccatccaccgggctttctaatcacagtcctgcctgagaagcgggccctgctgcccaccccttatcatggatcccttagctactgtccgtcttccattgctgcctggggctgggctgccgtttttgaacacctggcagtgtctttgtcgcgtcctgtcctctcttcttacagaccccaacccaggcctttgccttcttctctcctgtttggaagcctctgtatcttcaaggtgtgggaacagatttggttttctctaaaaagctagaaccttctgctgtgtgcagcaggcatcctccaggctggtgctggctgctctcgaggaagctgcgtcagagtggagctgcccctctactcagataaaatagcttcagctgcaggaagccgccccctcccatgcccaccagcccacagcccttcaccccacacagcccccagagtttgcccgacaccccctgagtgatgacnggtctcaggngggggccncccccacanatgggaggcggangcttnttttccccgcttgggctgggggcggctgctgagggggtgaagaagagatggcaatttatgtcgcatgtttagtgacacaatccagatgcaggtgggactttcttgagtggcaggtgtcaccctgggtcccgtgtgggatggtttaatacaggggtttgtgtgtttgtgtgtgtggagggccactgcgcccccagatcctcctctcccccgagggctgcgtctctaaacctgggaaaacatcagcctcaggaggaggcccctttccgggtaactgatgtgtgggagaagccaagaggcccctgcctgtctcctgaatgaggctgtgagggttgccatgtgggcgggaccggttcaaaatagcgcccccgcccctctaaattagaccgtggtctcagcatgatcatcttcagtagataagggacagtggctgatttactccaaatagttccagctggccactcagaccagggccagagttaacttctcaaacaccagccagctgaaaattagggttctcgtgcaggcaagtgcatggttgacacacagccctttggtgacaaagctgggctttgcctgcatagtgcagacaaggctgttggttcagaggctgcagggcacattccaggttggggccttttgtcggtcggaattcaataggacattccctggctgtgggtgtttagggcaggaattacaggcttgcagagaaagtcagaggcaatgagatgctcccagtaccaaactgtgacactgggatcagggtggtcattcccttgggtcagagtgggaccctagagccagagtgagctgtgggtggcctgggtgtgtcctgtggacggcggagactgttgatttggatgttgagctctgagtcagtttcagaaccaaggatctcaggctgagaaggccaggtccccatgggagcggcaggagtctgatggctctgctgccagagcctaccccagcctgccacgccgctgaccttcccatggtaaggaaggggcaggcagcatggttcccaccctcagctgccccagacccacacatccagccccaagagcagcctcacccaggcacagtgcagggcattttagctcctgggaggggagatgcctttgtgagtttcagatgtcagaggagaagctccgagagagtaagtcatgtgcccccaaacactcagctcctaagtggcaggacaggcaagtggccaggttgggccgcccccacagcctgtgccgtccacacactcactacagcactcccagaagaaggagcagaatcgcatgcagcccagagcaggtcctgtggaggggtcctcacccctcaggagtaatagggtgattatgtcacatgtttagtgatacaatcccacctgtgtctggattgtgtcactaaacatgcaacataaattgccatctcttctccatcccctcagcagccg

SEQ ID NO: 79075 - DNA, 223 bp, Homo sapiens
ttgcggtcctcttccactgctttccctccgccctgattttccattccttgtgagcggtggttttggttggggggagggggcggggaaggggcctggcgaggaggggcgtcagagcgctgtcaccgggtgtcgcgccgccctccccgcccctccgccgggcgtgtggggacgccggagggcgggagtctccgcgagccgcgcggcgcacggagcacggcggccg

SEQ ID NO: 79076 - DNA, 463 bp, Homo sapiens
gcggccgcctgagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactgggtaagacacggctgccgcgacccttgcgacccccaccccgccgcgggagggcgtggggggagagaagggcgcggccggagacctcctggcggggccgcgcgctccaagtgctgcgaccacgcgccaccgcccgctcctggcgtccc

SEQ ID NO: 79077 - DNA, 483 bp, Homo sapiens
ttctccaccctgggagctaccatgtgtaagcttcctggtctcagaatcaccagcaccaccttcgctctggtcggcatcttcatttcttggtgattttagctcctaactcactgtcattccctccatctccaagtgtggaaactcagtgcttctgaatccacacaggcaatccttccagcctcctgccctatatcctaaaagtacctgggttttgtttgaatcaggtatagtaaagtgacagactagaagacaagtgccacaaaggaaggatttagtactcgtggttctcaggaggaggggccctgccatgccacgcagggccagaaggggaagtaccagggtcaggaggagccaggagagagcatgacccagagccttttttgtgttttcctcagggtgaaaatggacaaggcagggtaggtaagtgtgagcaagtttaggattagatagcttgaatcatgaaaaaaaaataaaataaataaa

SEQ ID NO: 79078 - DNA, 1434 bp, Homo sapiens
tggtagctatagatggagcatacttcagagcaaggaaaattaccagggataaagagagacattacatatgataatgggatcaatgctccaaaaagacaaatgcaatggttaattttaggtgtcaactttactgggttaacagatacccagatagatggtaaaacattatttctgggcatgtttatgcaggtatttctggaagagattggcatttgaatcagtagactgagtaaagaagatgtgccctcacccgtgtaagtgggcatcattaaatctgttgagggccccagtagaacagaaaggtagagaagagacaatttgctctctcttctggagcttggacttccattttcttctgccatcagacatcagaacactaggttcttgggcttttggactctaggatttacaccagtggtccttcaggttctcagggcctttagcctcggactgagttacaccattggctcccctagttctcaggcctttggactcagactgagttacagcactggctttactgattctccagcttgtgaaacttattacttctataacagcataagccaatttccattaaaaattatatatatatacacacacacacacacgtatgtgtatatgtatctatagctatacatcttctattagttctgtctctctggagagccttaatacaggtaacaatctttaatgtgtatgcaccattacagcattaaaacacatgaggcaaaaactgatagaattgcaagaaaaaatagatgaatccactaatataattggagatttcacccctccatcataaatagacccggcaggtagaaaatcagtacggacataatttaactcaacaaaacaatgaatcaactggatatgatgaacatcagtagactgctacatgtaacagcagcagaatacacattcttctcaagctcacatggaacactcaccaagataaattatattctggcgaatagaacacaccttaaccaatttaaaagactagaaatcatatggtgtgtgctttggaattcaactagaagtcactaacgaaagctggaaaatccccgatacttggagattaaacagcacacttctaaataactctgggtcaaagaagaaatctcaagataaattttttaatattttgaactaaataaaagtgcaaacacaacttatcagaatttgtgggatacagttaaagcagtgattagagagaatttttatagcattggatgcatgtattagaaaacgagaaggttctaaaatcaatcatctaagcctccaccttacaaaactaaaaaaaaaaaaaaaaagcaaattagaatgaaaataagcagaagaagggaaatacagtagctctccaccccccttatccacagtttgctttctgcagtttcggttacttgtggccaactaaggtctgaaaatatt

SEQ ID NO: 79079 - DNA, 466 bp, Homo sapiens
tatggagaagggagggataggaattccatatttcaagatagcaaatataatttcatagaaatatatagctaaagattccaaagtgcttttacagagaactgttgaataatatattcctaaagggcagcaatatgccatgttcatggtgaagacagaaaaccaatgaatcagttgtggatctcaggtgggagaggaaacctcaggctcccaactttgacttctctactctcaccaggccatgttaacactgtaaaaccaaactctttgctaagaacaatacagggcagtagtttagtctgctgatgaaaccttgtgcttccaagaatattagctatatataatttgtgctttctggatgattctattgtccagaaagctaaccctgacgttacttttattagtctgttgttattcctcagggtgtagaagatttagtaaattcaggacaaattttatattcagtgac

SEQ ID NO: 79080 - DNA, 342 bp, Homo sapiens
caaaattagctgggtttggtggtgtgcacctgtagtcctagctacttagtgtgctgaggcagaaggatcacttgagcccaggaattcaaggttataatgagctatgattgggccactacactccagcctgggtgacagtgggagatcacatctctaaaaaataaataaataccaaggtgggaggatcacatgagtccaggagttcgagaccaacctggacaatacaatgagacctcatctctactttattttaaataagtaaataaaaaaccaaattgattgtggtgatggttgcacaactctgtgaatattataaaaatcactgaattgtacattttaaat

SEQ ID NO: 79081 - DNA, 483 bp, Homo sapiens
aatgggaaaaaaggaaaaatgatcagaagcaaaacaactgtcaactgcttctaaggagctggaacaatttgcttttgtgaagagactgacagataagagaaagggcggcttctcttccccacaccactcctcccaccaaagagtacggaaggaaggccggaaggaaaagctttggcaacttgaactccaactggaagcatccaatcactgttccaaaagctctttcagaacacatcaaccactttctactttttagactgctacttaaaattgagatatggtggactacaagagatattcaaactcctgcagtccaacacacttcactgatgaagaaccaagcccagaaggttttcaggtagcggcagagcctggaagggaacccaggtctcctgacgcacattccctattaattattatcccattccctaattatcattatgtgtttttatattataaaataaaaaggcattatagaaaaga

SEQ ID NO: 79082 - DNA, 503 bp, Homo sapiens
atttttttgagacagggtcctacttgttgctcaggttgaaatgcagtggtgaaatcacagcatgctgcagccttgacctcctaagtacaaacagtcctcccacctcagcctccacagtagctgggattacaggtatgcatcaccatgaccagctaatttttaagtttttttgtagagccacagtctcactatgttgctcaagctggtcttaaaatcctgggctcaagctgtcttcttgccttggcctcccagagtgttaggattacaggcatgagccactgtgtccagccatgtgcttttttaaactgttaaattctcacagagatcataaaacagtggtagtattggtgtaccaattttttttctgagttttttcccgaaattttgttataagtagagaaacataaaaaacattgtgttttagctcagaggttgactttggacaaatggtaattatgaaactgtttttgtctttagctgctttttgtcaattcatagcctgg

SEQ ID NO: 79083 - DNA, 1033 bp, Homo sapiens
caaatgacccaaaagcacctaaataagagtgacgagagtttaacagacattcattatggacttcagagaaaatgatgctaaactggtcttagaatcttctttaattttgttaactaggtaaataatctggacattttagtcaaagcattagacagacagagaagttggtaactgaccactaactaacaaactataaattcacccattgtgggttgacctggtaagttcccccagggctgtgtccttggcccctcctttgatattagtgacagatgactttttttatgccttacccattccacaaaagaatttgaagccatttacacaagagatagtactagtaaattaggagtgctgatcaaatttttagataataagaaacccttaggaaggatgacaatttagaatccaaatttaggatccaaacaaataccattacaaactataaaaatgagcagaatctaaatgtaacatttcaataaatgcagattgataataacatctgtgcagagttgaggactatagagtactgtgctgtcactaacagtattgtgtgctactaagagtttaatggctgggtgtggtggctcacacctgtaatcccaacactttgggaggcctaggtgggtaaatcagctgagatcaggagttcgagaccagcctggccaatgtggtgaaaccccgcctctactaaaaataaaaaaattagctgggcatggtggcacgtgcctgtaatcccagctactcgggaggctgaggcgggagaatcacttgaacctgggagacagaggttgcagtgagtcgagatcacaccattgcactccagcctgggcaacagagcaagattctgtctcaaaaaataaagtttattatgccaggagggccaggtgtggtgccacacccatgtaatcccagcactttaggaggctgaggagggcagatcacttaagcccaagagtttgagaccagtctgggcaatgtggcaataccttgtctcttaaaatttaaaataaaaaaaaagtttattatgcca

SEQ ID NO: 79084 - DNA, 513 bp, Homo sapiens
agtggcctggggtcttgggggcactgccctgtgtgttagcagtggtaattttaaaggtggccctctctgactagtgtccagccgatggggattaggctggcctttgctttttgccaactttagaggcctctgcaggcagcaggctggacagctctggaactgggctgtttctgctttatggatactcctctctttggtgaaattcagccttccatggctatacaaaagatgaattccacatccacgtagtggctctgccagcttccaaagtaagctcttcgggtcagactctcaccagaccaaatgatgcctggtccctgggcctccccctgtgacttggcttttggggtatagcttgatcactggctcctggacccatcctggtttattaatgcctcccctaaacatagcaccaatcttcatttcgcctgtgctagcacttcaaatgtattggtgtggaagccagctggaactgaccagatgagctcatctaccattgcccagccaggagtt

SEQ ID NO: 79085 - DNA, 555 bp, Homo sapiens
acgtactgagttcgtgtcttttggatgcgcgcccagaggtggcactgctggatcctgtgctgggtcatacctatgtttaattctctgaggaacctccgtgctgtctccatagcagccgtgtcgtttcacacttgcaccaacagtgcacagggctccggttccccacgtcctcaccgggtaactggggttccggctccccacgtcctccccgggtaactggggttccggttccccacgtcctcaccgggtaactggggttccggctccccgcgtcctccccgggtaactggggctctggttccccacgtcctcaccggcacttggcactgtctagtgttttggtagcagccatcctgctccgtgtaggtagtatctcattgtggggttttgttgttgttttttagagacagcacctcgctctcttacccaggctggagtgcagtggcacaaccatacctcactgcagcttcgacctcctgggctcaagcgatcctcccacctcagtctccccagtagctgggatcacaggcgtgcaccaccatgcctggctaatta

SEQ ID NO: 79086 - DNA, 415 bp, Homo sapiens
acgtactgagttcgtgtcttttggatgcgcgcccagaggtggcactgctggatcctgtgctgggtcatacctatgtttaattctctgaggaacctccgtgctgtctccatagcagccgtgtcgtttcacacttgcaccaacagtgcacagggctccggttccccacgtcctcaccggcacttggcactgtctagtgttttggtagcagccatcctgctccgtgtaggtagtatctcattgtggggttttgttgttgttttttagagacagcacctcgctctcttacccaggctggagtgcagtggcacaaccatacctcactgcagcttcgacctcctgggctcaagcgatcctcccacctcagtctccccagtagctgggatcacaggcgtgcaccaccatgcctggctaatta

SEQ ID NO: 79087 - DNA, 300 bp, Homo sapiens
atattcaaggagtagtggagtacgtgataatgcactagatttaaagttacccaagggctaatttttaaaaaatcatttttcatatccaatattaaattggttgttagttcttttctatatgtctgtgataacctttgtgccctggttagcagggtctagaaagagccatccatctcaacaacagtggatttagacttgcaggaaacatacagcttgagtgatttggctgtatctttaatgattcctgaacatctgccagaagttgctcatttcaagcaagtcagtgatttaagcttattt

SEQ ID NO: 79088 - DNA, 344 bp, Homo sapiens
tttttttaagagaagttctctctctctcaggctggagtggagtggcacaatcatagctcactgcagcctcaaactcctaggctcaaacaatcttcctgccttaggcatcccagcactctgggaagccgaggtgggaggatcacttgagcccaagagttcaagaccagcatgggcaaagagagagaccctgtctctacaaaaactaaaaaaattagctgggtgtggtggtgcctgctgtaggcccagctagggggaagtagaggtgggaggatcactgggaggtagagactgcagtgagccgtgatcatgctactgcactgtagcctgaatgacagagtgagacc

SEQ ID NO: 79089 - DNA, 938 bp, Homo sapiens
tccaaaccatgctgttaaatatcagagttcctatggttatgactgacaaatgacaataatagccccaaaatacatatttttgatactatttagccaagattaccacaaagatacagtatttgacacattcttattctataacattttgaaaatattttctcttgacagataaaaatgtgtactttttctgtagaacataatattttgaacatgctgttaaatatcagagttcctatgattatgactaaaaaattaaatgacaatagtccccaaactatgtattttcatactatttagccaaagtaatcacaaagacacagtatttgacacattgttattcttttatgtcttaaaaatattttctttcaacttgagaaaatgtgtgctttttctgtagaacatattttgaagtatatatacattgttattatttctaggtaattaatacctcacatagttaacatttttgtggtgagaccacgtcttatcatttttcaaaaatccaaatacattattatgaactatagtcaccatgttgtacaataaatctcttgaacttatttctcctatttgactataattacttattatttgacagactttccaaacccccatttcttctaaataccttggcatctgatggtcaccattttactctatacatcaatgggattaagatttttggaatccatgtataggtgaaatcatgaaatattaatctttctgtgcctggcctatcccaactaatataatgtcctccagcttaatctatgtaatttaaaataatataatttttttcttttttttttttttttttaaggccaggtgtggtgtcttacacctgtaatcccagcactgtgggaagccagggcaggtggattgcttgagcccaggagtttgagaccagcctggtcaacatggaaaatccccgtctctac

SEQ ID NO: 79090 - DNA, 1623 bp, Homo sapiens
gaggattaccctcaatcttacagacataacataattcatactgaaaagaaactctacaaacttgaaagatgtgacagtgcttttgacaacacctcaaacttttctaaccataaaagaaattatactggtgagaaatcttagaaatgtaaagaatgtgacaaggcctttaaatggttgtcacacttcattataggtaagatagttcatactgaagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactagaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggccaggtgtggtgtcttacacctgtaatcccagcactgtgggaagccagggcaggtggattgcttgagcccaggagtttgagaccagcctggtcaacatggaaaatccccgtctctac

SEQ ID NO: 79091 - DNA, 1473 bp, Homo sapiens
atgtgacaaagcttttaaccgattctcataccttactaaacataagataattcattctggagagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactagaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggccaggtgtggtgtcttacacctgtaatcccagcactgtgggaagccagggcaggtggattgcttgagcccaggagtttgagaccagcctggtcaacatggaaaatccccgtctctac

SEQ ID NO: 79092 - DNA, 1964 bp, Homo sapiens
gaggattaccctcaatcttacagacataacataattcatactgaaaagaaactctacaaacttgaaagatgtgacagtgcttttgacaacacctcaaacttttctaaccataaaagaaattatactggtgagaaatcttagaaatgtaaagaatgtgacaaggcctttaaatggttgtcacacttcattataggtaagatagttcatactgaagaaatcttacaaatgtgaacaatgtggcaaaggctttaactggtcttcaacccttacaaaacataaaagaattcatactggagagaaaccctacaaatgtgaagaatgtggcaaagcctttaatgtgtcttcacaccttactacacataagatgattcatactggagagaaaccctacaaatgtgaagaatgtggcaaagcctttaaccactcctcaaaacttactatacataagataattcatactggagagaaaccttacaaatgtgaagaatgtggcaaagcttttaaccaatcctcaaaccttaccaaacataagataattcatactggagagaaactctacaaatgtgaagaatgtggcaaagcttttaaccgatcctcaaaccttactacacataagagaattcacactggagagaaaccctacaaatgtgaagaatgtggcaaagctttcaaccgatcctcaaaccttactaaacataacataattcatactggagagaaatcttacaaatgtgaagaatgtggtaaagcctttaaccaatcctcaactcttactaaacataggaaaattcagcagggcatggtggctcatgcctgtaatcccaacactttgagaggactaggtgagcagatcgcgaggtcaggagttcaagaccagcctggccaacatggtaaaaccccatctctactagaaatacaaaaatttgctgggtgtggtggcaggcgcctgtaatcccagctacttgggaggcagaggcaggagaatcatttgaacctgggaggcagaggttgcagtgagccaagatcgcgccattctactccagcctgggccacaaggcaagactctgtctcaaaaaaaaaaaaaaaaagaaaagaaaattcatactggaacgaaaccctacaattgtgaagaatgtgccagtgctttcaaccagtcctcgaacctttttaagaaaataatttatactggagagaaattctacaaatgtgaagaatatggcaaagcctttaaccagtcttcaactcttactaggcattaaaaattcatactgtacagaaaccctacgagggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcacaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaaaccccatctctactaaaaatacaacaattagccggttgcggtggtggtgcctgtaatcccagctactcaagaggctgaggcaggagaatcacttgaacttggggagggagaggttgca

SEQ ID NO: 79093 - DNA, 744 bp, Homo sapiens
agtaacggtgtgaagacacattaaaggctttgccacattcttcacataatggagagttaccttacaaaggtgaaaaacatggcaaagcctttaacaagccctcaattcttaacagacataacataattcatactggaaagaaactctgcaaaccagaaagatctggcaatgcttttgacaacacctcaaacttttctaaccataaaagaaattatactggtgagaaatcttagaaatctgaagaatgagacaaagcctttaaatggttgtcacacttgattgtaggtaagataattcatactggagaaaacacctacatgtgtgaacaatgtggcaaaacttaaccagtgctcacaccttattgcacaggaaagcatttgtacttgagataaattatacaaatataaagactgaaaaagccattaatatatgttcatatctcaacaccagatagttcatacttaataaaagcattataagtacaattactgtcaaaagacctttcagaaaatacaagcttttgaccaggcgtggtggctcaggcctataatcccagcactttggtaggccaaggcaggtggatcatgaggtcaggagtttgagaccagcctatccaagatggtgaaaccccatctctactaaaaatacaacaattagccggttgcggtggtggtgcctgtaatcccagctactcaagaggctgaggcaggagaatcacttgaacttggggagggagaggttgca

SEQ ID NO: 79094 - DNA, 721 bp, Homo sapiens
gaggattaccctcaatcttacagacataacataattcatactgaaaagaaactctacaaacttgaaagatgtgacagtgcttttgacaacacctcaaacttttctaaccataaaagaaattatactggtgagaaatcttagaaatgtaaagaatgtgacaaggcctttaaatggttgtcacacttcattataggtaagatagttcatactgaagaaaacttctacaagtgtgaacagtgtggcaaaacttttaatgaatgctcacaccttattgcacaggagagcatttatacttgaaaaaaattgtacaaatataaagaccatgaaaaagccattaatatctattcacatcttaccactggagagttcatacttaataaaaggaatataagtgcaattactgtcaaaagatctttcagaaaatataaacctttaaagcgaagaaggtatttattttgaagatgaacactacaaatgtgaagagggttgtagtacctttatttgtatcacagattttattgtacacattttgtactagaagaaaactctgaagtagttgctcaaactttgttcaacatcagggaatttatattgaagaaaaactttgcaaatttaataaattttaaaaaacactttttcaaaaagtacagcttagaagacaccagagttcatactaaaatatatttttgcagatgcagtaaaaatgaaaatatttaatcca

SEQ ID NO: 79095 - DNA, 229 bp, Homo sapiens
tactgtagtgttttaatgattgaatttatattggagaaatagatatgtggagtgttatatttcatctagaactgtgggaataagtataaagtgttgttttcccattccagagaagttattttaatattgttgaattttataagctatttcaaaggacttattagcccattttgctttttgtaccttttataacctactcacccaaacttttttgtgcttacaaaagaaa

SEQ ID NO: 79096 - DNA, 291 bp, Homo sapiens
aaaatcaattcattcctgaattgagtacctggagtgagcacagaccccacgagttaggggcccaaaatctcacaagacccctaatttcagacaccagccacaaatggggttcctgggctaccacacttgtgtcctgctgactgaattctggggttcccatgatacacacacacacaagtttgataattcattagaacagctcacagaactcaggcaagtgccatacttaccatgacagttttgttagaaaagttacaactggctgggtgtggtggctcacgcctgtaatcc

SEQ ID NO: 79097 - DNA, 497 bp, Homo sapiens
gagctctgatttgtaaccactgcttattaccataatgtgaatactcccacccattaccgatttcaagctaccaacttgatgtctgtcagccagcttgcaaaaatcctgaaaatgtaacaatcagctcttgtgcaacagtatgagcctgagccagctccaacatacaaattctataaattcattaaggcactttttgaattacaaatgtctttgtacataagagaaaatgaaatgatcactagttacagaagatataattacatatgtagaaaaatctaaagtaattcatgtaaaattaatataagcaatacacaatttcagcaatgggactagattaaatagttatacaaaaattatcttctctcgcaaaaataattagttagcaaatgtgatggtgaagatttccccatcatagtagcaatgaaacaataacagcaacaaagccttagaatacctggaaatacatttaataaagaatgtacagtttctagaagaat

SEQ ID NO: 79098 - DNA, 380 bp, Homo sapiens
acgggtttgaactgcgagagtccacttatatgagggtttttgaaaataaaagttaccccgagtgtgcctgcctctcctgccttcccttccacgtcctccacctcttctgcctctgccacccctgagacagcaagaccaacccccggcttctcctcctcagtctactcaacctgacgatcacaaggatgaagacctttatgactcacctttatgattcacttccaacatatgactttgtacagaaatcaggaagatgctttgaaagaaacactgtgcaatgaaagtgccactgatgtgtctagcattgacatgcttttggctgcaaagacttgagcccacacgttgcctgaaaccttcagtcctttgaagctgtgatttca

SEQ ID NO: 79099 - DNA, 495 bp, Homo sapiens
tcatagtttatgtaaatggtcttgaaaggtgtttcatttagagagcaaaacaagaaagcaacatgcagaagacatttgattttagtcttcagtgcatgataggaaaacgaaggtgtgtagttcagtaaaaagtaattattcaggttttagacagtaaaggaaaacgttaatcatggatagtcgacccaaaacaaattgtgtttgtagatatcctgacatgtgcaaaaacctttagggaccatgttcaaagtgaaagacatggtaaattacaaaccaattctgctgatatttgctaaagggtctttaaagcaattcttgtcagaagcaagttgtccaattcattggtatcttaaaaaatacactcagcactcctatctctgcccttaagtgaccattctgtataggcctgccttaggcccacattgtgattgcagatttcatgtacctactgtagcaggaataactaattaaactgacattgaaaatatgtttaaa

SEQ ID NO: 79100 - DNA, 450 bp, Homo sapiens
ttgatacagaaaataatgttagatactgaacaaataattttttcttcggtaggaggtcctatattgctgttgtgtatccttagtttctttctttctttttttttttaaatggggtgtcactctgtcacccagtgtggagtgaagtggcatgatctcagctcactgcaacctccccatctcacgttcaagtggttctcccgcctcagcctcctgagtggctgggattacaggtgcctggcaccacaccaggctagttgttgtatttttagtagagatgggatttcaccattttgaccatgctggtatcaaactcctgacctcaggtgatgcacctgcctcagcctcccaaagtactggaattataggtgtgggccacctcacctggccttatttagtttctttaatgaagattattgatatgatatggctgtgtaaaatagtctttttatt

SEQ ID NO: 79101 - DNA, 369 bp, Homo sapiens
tgggcctcccaaagtgctgggattacaggcatcaaccaccgtgcttggcctatggctgagtgatttcaaacagaattccatctagcttttagaatggtagctaccaaggaaaaaaataaagaaaaaaaaaaaaaaatctctcttcaatttcagctgtagacaatgaatacatttccacaaaacaatgtgatagataattgatgagttaaatagattcctgaaaacttcaattcctttttttagcagggtaaatccttggtagtgaacatctttgttctatatcctgtgtttttttgtgtgtttgattgttttttgagataaagagttgcactgcgacacccaggctggagtgcaatggtgcaatcttag

SEQ ID NO: 79102 - DNA, 765 bp, Homo sapiens
gactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaaaaaaaaaaaaaaaaaaaaaaaaaaacttttgggggggcaggggcccccgagaagaaaccttctaaaaaccctcgtggatagaggaggcgggggcccagagagggacacagctgaacaggtggtcccacaacggtgttccccaagagaaaagaacccggggccaagacacagagggagaccggagatatctcacccacacattataacaacaacggcccgggcgggacacaccggaccggttctgggaccaaacccccaaagagggagtcccaggagacactaacggggctcaattacaagcggagtccaacggcagacccgcaatctcaattacccc

SEQ ID NO: 79103 - DNA, 3816 bp, Homo sapiens
ggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttatcgcttagatgacaatagtgctctttacatgttttctgtttgaacctaaaatagcagttgacatggtggtcctgaagcaaagcctttcaccagtaaagagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattacagctgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaat

SEQ ID NO: 79104 - DNA, 3722 bp, Homo sapiens
  misc_feature (2)..(6): n is a, c, g, or t
  misc_feature (10)..(10): n is a, c, g, or t
gnnnnngttncgcggaggggctcagtgaaaaaatgagcgagctagaggaagactttgccaagattctcatgctcaaggaggagaggatcaaagagctggagaagcggctgtcagagaaggaggaagaaattcaggagctgaagaggaaactccacaaatgccagtcggtgctcccagtgccctcgacccacatcggcccccggaccacccgggcgcagggcatctcggccgagccgcagacgtacaggtccttccacgacctccgacaggcattccggaagttcaccaagtccgaaaggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttatcgcttagatgacaatagtgctctttacatgttttctgtttgaacctaaaatagcagttgacatggtggtcctgaagcaaagcctttcaccagtaaagagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattacagctgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaat

SEQ ID NO: 79105 - DNA, 1094 bp, Homo sapiens
ggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggctggacttggaatctgtttgaatacgttgtggaataaattccttaatttctaataaatcagtgttatattaattggaa

SEQ ID NO: 79106 - DNA, 1037 bp, Homo sapiens
ggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagaagatggagtcttgctatgttgcccagctgttcttgaactcctgggctcaagaagtcctcctgccttgacctctcaaagtgctggaattactggaatgaaccactgggcttagccccatttttcacctgtaaccttagtttgtacaattgttgacttttctgttagaaaatagggaaccttcgtatttaaataactttatagcaagtattgaatgtcaaaggttaacttcaaatagcaaatgctttttagtgttcctctacccaatgtaaaacaacaaaattaaccaacttccagagcagtataagaattctaaaagcatcattacaccccctggctttacattttacactccatatactgcaaa

SEQ ID NO: 79107 - DNA, 968 bp, Homo sapiens
ccgctgcgtgcaccaagtgctttgaaagtttttcgccgtattaaaacgaataaagaacctcgtgcgaataggcaaagaaggcagggttgaaaagtactcagctcgacaccggagaaagaaagaaaccccgcataggaagctccggttgttcgggtgtgtcctaagcagacctcactctggacctcttgtgacctcgtgagtccgtgtccccagtccctgcggggacagctcaggaagagagcgggttccaggacagcccaagcatccgaatcaagttatctacaccttcgagactgagcaatagatgaacgaatcgagtctatttgggcattttccaggggaaatgaaagtgtatgcccaaagaaggacttgtatttcaatgttcgtagaagttttatgcacaagagtccaaaactgcaaaaaaatccgaaagttcatcaactgggatggtgtgaagtgtctacaggcatccgagtgaacccaaagggagagtttggctggcacacggggagacgggccaaggcgcggcgggcgagggcggcacaagcatggcgctgcgacaccactgctgggagcagggctgaaaggtgtcttttgctgtaaggactttcataaggcagtcccaatccaaagactggctttaatttcacggccttagcctctcagtttcttaagccttctgaggacctcctgatcatgacaattaagtcactatttacagccatgtgacagataaatcagtattaggtgatttgttctgaaggacccccaaaaggaaacatatgagagaacccacactcggcacaggaacggcaagagtcctcctgtgagagctgagagatgacattggccctgagtctgtccactgctgaagcttggcagaggcgggggaagcgctcagaacagtcggctgccactgcttagtggaggggagggcgttaacgcgtttccccatcaaaaccaaaaca

SEQ ID NO: 79108 - DNA, 992 bp, Homo sapiens
cgaccacagcctcggtctcgcagctgcagcccccgccccgcccggccgcgaagcgtctggaaccgcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtccaaaaaaaaagcttc

SEQ ID NO: 79109 - DNA, 882 bp, Homo sapiens
cgaccacagcctcggtctcgcagctgcagcccccgccccgcccggccgcgaagcgtctggaaccgcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcagggtaaccacacccaccccacccactgtggggactcaggacaggaggagaaggtggaaggcagctgggggtgcctgggttccgtccaggccagtctggggtccccttgctctcagggaggagagggtggcagtgagtcatcccgcccagagctggccccaccggctgccctgcacccaccaggccccctcccgaggctgcaggtgcagactgaccaaacagtggcgctcctgagatgtttttctttctgggaagtgcccgcgagtgctgcttgcttgtttgcccagtgggtcattgtctcatcttcagtgacttacgggctttctatgtaatacttcctttctgcagtatatctggcaaatatcttctctcatcctcttgtttaaatctgtcaatgttactaatgatagctttagtcatttttagtggactgtttccaaagccttccattctccagtagacagatctgctagggctcccc

SEQ ID NO: 79110 - DNA, 1152 bp, Homo sapiens
cgaccacagcctcggtctcgcagctgcagcccccgccccgcccggccgcgaagcgtctggaaccgcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggggccctgagttctgaactggaggctgatcttcggtgtcctgaagccatggctccattacaaactgtccgcagtgtccccaaccgcagaagcgggagggcctgggcccggggcgcacaggagggctcagccccaccgaccctgacccggcccctcccgcagcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtccaaaaaaaaagcttc

SEQ ID NO: 79111 - DNA, 836 bp, Homo sapiens
tagcttttagtgtgtttttagaaagccttttatttatcagaagtaaaatctgctccttttctccttaactccatggtttatgctctggagcgcgctccgcagagtccttgctgcgctgggcaggtccactggtgtctgcgcccctctccctgggtggcccctccccttacaacgcgcgacctcctgctccatgcccctccagggccctgagttctgaactggaggctgatcttcggtgtcctgaagccatggctccattacaaactgtccgcagtgtccccaaccgcagaagcgggagggcctgggcccggggcgcacaggagggctcagccccaccgaccctgacccggcccctcccgcagcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtccaaaaaaaaagcttc

SEQ ID NO: 79112 - DNA, 1024 bp, Homo sapiens
  misc_feature (977)..(977): n is a, c, g, or t
  misc_feature (1006)..(1006): n is a, c, g, or t
cgaccacagcctcggtctcgcagctgcagcccccgccccgcccggccgcgaagcgtctggaaccgcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtgatttacgttcagnattacaattactggccgcgtttaccgtcntgactgggccttgcgttc

SEQ ID NO: 79113 - DNA, 382 bp, Homo sapiens
gtctccagccccgcagcccggcccggggtaggtgcgcgccgcggggctccggccggctctgcccaggtctcttcctggcctcccgccaccgcttctgagccaaagacccccgccacccttcccttcctcttccctccgacccggcccgccagaacctcggggttgggggttgcgaatccgagcccgccgggtgacgcggggtccgcggggagcccctggccgcgtcgccgctctcaaccctcgggctctgtctccgcagcgtcctccgccagctcctgtgaccagcgcgtctcccgatgctctccgccgtgttcgtgtccccaggcgccctcgctgcagccccgcccccgtgggtctctgactctgtcgcttttctctaagt

SEQ ID NO: 79114 - DNA, 469 bp, Homo sapiens
  misc_feature (364)..(364): n is a, c, g, or t
  misc_feature (372)..(372): n is a, c, g, or t
gaagtgtggagcacatgactgggttccccccatgaagaccacacatgaacagcagctcattaccagcctgatttcaggatgaacttttatgcagtcacggagtgagtgaacatgcatgattcttagtgtgacatcagaacacaaggcctccagagggatgccaatgcatgtgagcaaaggcaggcagcctgactggtacttggcatctcaggactcagctggagggaggagggaagaactacactatggcagaggccacagccactgtggggcacctgatgttccccagacctaaacagctgggcttccccactgccctactttcccttcagttccacctgccactcctcaaaccactcgtagntgctagtnatgagcatgatcatggtggaccggcctggggatcagagctgatattactactcccgcctctccctccaccccctcaccacagaaggatcctctagag

SEQ ID NO: 79115 - DNA, 694 bp, Homo sapiens
gttgtgacttcccccagagtcacacagctaactggggcaacccagggccattatctcatgactcccaggcttcagtactggaaaaataatcgtgtcatgctttcctttctagatggtagaaactttggaatgtgtgattttgaatactgagaacagcccaaaaatgtcacatagtccctatgctaaagcacatgcattttatcagtagggacaagattgagggccatcacttaatttaaaacaaattgtaacccatctagtgatctggactcttggcctgtagatgagatacaggaaagcggatgtaagtgtgaaggcaacagcccagtgttgctgagtgccgggcacagcatgtgccatcatttcacagcaactaaaatgctgaccttacaggttcatggtttcatttttggtcttcatgaaaagcttgaattctctttagcttcagtttgcaacacaaataaagaatatatttgagactgattgtcacagaattttctaattacccacatgtggagcgatttcctaatgtgaaatacttttcttgatggtatgagatcagtaccattggacatacacagtttattcagttggccttttggtaaaaagaagttctttggtatgcaaaaattttccaagtcacttcttgcaatattataaaatgtattacttgaataaaatgttgaactcatgg

SEQ ID NO: 79116 - DNA, 529 bp, Homo sapiens
agaaaccaaaccccaagtcctcactctttagtggtctgagatttggcaaaatcaggtatcctggtcaaagcatagattcaaatattgtgggtatctgtcctagacagtggacagtggctagctcaacgacactgctgttttgtgtgtctctgggaagacctttctaaggaagaaaacaagaaaacctgaactttttagattgcgtttttatttttctttctttcagttgtcatttttattattttgcttcaggcgaatctcaagaacacggcctgataggcttagcttaagactggctatcctccatgggtcctgcgcagggaggaactgggctgagtagttatttagctgcctcccattccatttggcagatcttagtgccaggttttctttagatggggaggcacctctcttgggaatggacttctctcccacacatgtctctttcattaactccgagaccttattccttgaccttagctcaagttatttaacttctgcatccttttgccagaggtgtctcaagggc

SEQ ID NO: 79117 - DNA, 436 bp, Homo sapiens
gcagtagagacattttaaaaagacagaatgatcaacacagtcacacgtacagagccgcccagtacaataaggcaaaaaatgactgtcagagtgacctttccaaaacaattctagttaaatagtgtccttgaatataaggcaaaagagaagaaaaggaaaaaggaggaataagccagcttcccatgacaactgctgacataatgacaaatctggtatttttgtcttggttctacaatgtctgaaggataagacctggaatacgagcctcacatggggaagcacagcacatatttccaaacgcagcctctaataatccaagtgccttccaagtcagtatgcagaggactgaggcaacaaaacaattgttgaaacagctgagtgggatggaactgaacacatccaggaggcaacaactacatgggccgacagtgaaatt

SEQ ID NO: 79118 - DNA, 252 bp, Homo sapiens
tggctggactcagctgcaagttggattcaggtctgctccgcctctctccatcctccttggacacagtagctacccagacttattattctcatcgaaaaattggaagcacgagaagacaagcacaactccagcaagacactttaagccttttctttaagtctttgtcaaagcaaatcacacaactaagtccaagattcaagtgcaagcagggaaggacatctcacccaccatgaggccaaagcaagttatagg

SEQ ID NO: 79119 - DNA, 446 bp, Homo sapiens
tttcttgaggcctccccagccatgtgaaactgggagtcaattaaacctctttcctttctcaattacccagtctcgggcagttctttatagcagcatgagaacagactaatacagaaggtgtgtgttaaagggggcagcatcacaaaatggaagggctgaaacactgactccctgcttttcgtaaaactgcccacaaaggctgccttttccacagtgataactcagcttttgtgttgttacacactgagagtttagggtcgtttgttacttcagcactgtctaacctactgtgactataactatgggtctctggggaaaggcgccctagatgaaaggaccatatttattgaagactgggagtctgatgtgcaagacatcattaacatctgtattatagtcttgagactgtgtatgctttgtgagctttaatgggagatgggtcagat

SEQ ID NO: 79120 - DNA, 353 bp, Homo sapiens
tgcaaattagacacagtgtctaatgtggttgagtccccaacattcattctactgcacatgatttgcctaactagtcatggtttagtttagtaatggattacttagcatgattacttagtgtgaaggccaaggtgttgtaatagaaatctcaaaattcagtagcataaagaagatagaagtgtctttctctcataaattattgtggccagtccaaactggtggtagggtgggagagatgtggatagcacaatttcatttaggggcctaggttttttctttctgttgctctatcatctcctagaacatttgaattgtaggaaccggttgtaggcatggcagggctctaacttgca

SEQ ID NO: 79121 - DNA, 1499 bp, Homo sapiens
ccagtactggggccttattgtccagccttccacctccaggagcccactcagtgatgacttttgacaaaagtcacccggattatccctcttttggggtccatgatgccaccaacggctaaagttaacaaatgcattaccaggaggtaccactgaggtaaggattgttactgtaagtgattttctctgattttgaccactacaagtaaaatcacaagatttgtcccaaatactatataaagaggaatgtcttttatttctcgaaattgttctgccactttgtttgttcaaataacacataataaaggataaatggcttgtagctatatttatccaaattgaacatttttgatgtaatttttttaatttgtcaaaagcatatcaatggtcataaaaattttttatgtcctctggccctattaccttacccttgggaatttattccaagaacgtaatttgaaagagattaaagcacataggcacaaatattttcagtgcagtattgtttatattggaaacaacccaaatgttcagtaacagggggaacaattttgtaaatcttgctacagcaacttaacaaaattataagctgccacttataattgtaaattttgaaagtttgtagcacagcaaggaaactgatcatgttaaatgtttctgatatcttagttaatttttctcccgccagttccgatcggtgtcctggtcataccgtcagcatataagtatgtatttcataaacatttactttgtattaactcagtagtattcccttcctagagtggtttgcttcccagattgtaatggacaatcatctcacctggggatcttgtaacaatgtgattctgattctgtaaactttgtggggagcccaagattccacatgtcttagaggctctcagatactgctgatgctgttgatcacgaatcacgcattgagcagcaaggtcctagagctctttgtgtatgaagaagatactactgacccagtgcctcgctatcttgaaaggcagctgtgacctttctagcaactgagggggtggggactagaaacgagtgttttctggtgtttctctaataaagctgctgtcttgtatccagattgaccatcagtatccttatgcccttcaactaacttgaaatttgtcagttaacagaaattactgggtggcactaaaataaattattcttaatataaagggtaagaaagggttgggtgtggtggctcatgcctgtaatcccagcactttgggaggccaaggtgggcagatcacctgagatcaggactttgagaccagcctggccaacatggcaaaaacccgtctctactaacaattaaaaaaaaaaaattagccgggtgtggtggtgggttcctgtaatcccagctacttgggaagctgaggcaggagaatcgcttgaacccgggaggcggaggttgcagtgagctgagattgtgccattgcactccagcctgggggacaagagcgaaactccatctcaaa

SEQ ID NO: 79122 - DNA, 604 bp, Homo sapiens
ggggcccgaagcgtttactttgaaaaaattagagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagcactacaggcccatgaattacttcctcacttttgcagttgattactgaaatgtaaatcacaagaatttgtcaattaaatcattttaaactgca

SEQ ID NO: 79123 - DNA, 513 bp, Homo sapiens
ggggcccgaagcgtttactttgaaaaaattagagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagca

SEQ ID NO: 79124 - DNA, 439 bp, Homo sapiens
tggttgtgcagggcccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagca

SEQ ID NO: 79125 - DNA, 489 bp, Homo sapiens
atggctgctgccatattcagaggcttgatatgattgctgctttgccaaggggacacttccaatagacacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagcactacaggcccatgaattacttcctcacttttgcagttgattactgaaatgtaaatcacaagaatttgtcaattaaatcattttaaactgcaaaaaaaaaaatcggcctcgctggactcaacggcggacccatgtggacgt

SEQ ID NO: 79126 - DNA, 667 bp, Homo sapiens
tggttgtgcagggcccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagcactacaggcccatgaattacttcctcacttttgcagttgattactgaaatgtaaatcacaagaatttgtcaattaaatcattttaaactgca

SEQ ID NO: 79127 - DNA, 707 bp, Homo sapiens
tggttgtgcagggcccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagcactacaggcccatgaattacttcctcacttttgcagttgattactgaaatgtaaatcacaagaatttgtcaattaaatcattttaaactgcaaaaaaaaaaagtcgacgcggccgcgaatttagtagtagta

SEQ ID NO: 79128 - DNA, 961 bp, Homo sapiens
gcagatacttctttaagaataagagatacagattctgtaacatctattggctccataattctgaagtcttatattaattattctacaatttccttaagtgaagaacagaggtaaataggctataggaagcactgaaaaaggaaacagaaaatactgtcttttgcaaattgaattatttaaaaatagtttccaaatataaaaattagaactttatctacattgaatcatggggttttctaatagggtgaagcaaagagagtttcttttcattaacctctccaaaaacaataaggcagatcaatatccttggatatggaatatcaaagcattcaaactactttttaaacagtgataagagccttggaatacattaatataagaagacaagggcataatgttattctaagcatccagtgaggaatgcctgcttcaaaatttgcagactctaattctaccagaaataaaagatatggagcatttttaatcagaggaaaacatgtcttacccttagaaactcacctgtcctttactgtttctgttcttcccaatcctttgttcttctaagcaaagaaacaaaaggaaagtaaaaaagcttcatcctgttggggtccacaagtaaaataatgtaattcataagcatttcagtacgaatgagaaaagcagagctactttaaaaactattattatttaaaaagaaaaataaagaattagctccccaacagttaatttttgtaaagcgattttttaaaaaaagaacaaaaccataacaggcagaacactgatgtatttcttacccctgtatctattacaatgattgtattaagttactcatggggttggctaaagaggtttatatgtagattatcacttcatattttcttttgttctttgaaaatgtgcatggaagccatgttatacgttattagagaatgaaaacatgaaaaatcttgaccatcctatc

SEQ ID NO: 79129 - DNA, 361 bp, Homo sapiens
cttctcctctccatcaccactgaagtattttaaagcagatcccagccatcaccttaaagtcatgcacttcattcataacaacgttttggtcattgacagaccacatatatgacagtggtctcataagattataatactgtgtttttacagtgccttttctatgtttagatatgtttagatacacaaatccttaccattgtgttgcctacagtattcagtacagtaagtaatacattgtacaagtttgtagcctaggagcaacaggctatcccatatagcctaggtatatggtaggctataccatctagatttatgtaagtacactccgtgatgtttatacaaagatgaaatcacctaaaga

SEQ ID NO: 79130 - DNA, 211 bp, Homo sapiens
aaattgagacccttctctatatatttcgtaatcttctttgtttagagaaatatattcctgtaacatatttccataacattaaatgaccttctataacattttaaataactacagagtattccatgttaaggatgtatcataatggacttagtcattatatctttttttaaaccatataaaagatgtcgacgcggccgcgaatttagtagta

SEQ ID NO: 79131 - DNA, 548 bp, Homo sapiens
ttgggagatcttgtgtgaatgtgttttattcaaaaggtactcagagaagaccaaaagaaatcaggaagaataaaaaaggccatgattacttcctactggctgagaaacctcaacacaggcagcatttctcatgccgaccaccatcctatattgtgctatagatattcaccactgttcccatcacttctactacaactcagactctagaatatgtaatcctgtgtggatccttgtgtctaagagtgttgatatggttttgctgtgtctccacccaaatctcatcttgaatggtaactcccacaattcccatgtgtcatgggaggaacctggtgggaggtaattgaatcatgggagtgggtctttcttgtgctgttcccgtgatagtaagtctcacaagatatgatcgttttaaaaacgggagtttcctgcacaagctctcttctcttgtctgatgccatgtgagacacatctttcaccttccatcatgattgtgaggcctccccagccacgtggcactgtaagtccattaaacctctttcttttataaa

SEQ ID NO: 79132 - DNA, 330 bp, Homo sapiens
caaaggttaagaatgcctttttgttcagtttcactgctgatgaagatggtgggttggatacaatggtgttttcaaaacacttggaaataataatgcccatgttggtattgcagtacttttttagccacatacagtatccaagtcacaaatcatttctcctgtacttagtaattttagatgtattataatctagtatcatcccacttgtttcaaattactcccatgaatttacattacaaaccattttgagagcccagggaatctcaggtgtaattctaatctggtattgattccatatatctttgggggtaaatatttgctgtattaaaa

SEQ ID NO: 79133 - DNA, 242 bp, Homo sapiens
atcacttgaggccaggagttcaaaaagaaattttaatagcaaataaacatatagaaagatgcctagcctcactggtaatcagagcaatgcaaacttaaaatgaggtttttctcctcattaaactggcaaaaatctaaaaaattgttaagatccattgttggttaagatgaagagaaatgagcactttcaaatactgctggtatgaaaggcaatttgacaataactaccaaaatttaaaatat

SEQ ID NO: 79134 - DNA, 493 bp, Homo sapiens
tagcgcagctgtgttaggccatttctgcatttctgtgaaggaatacctgaggctgagtaagtggcaaagaaaaaaggtttcattcactcacagttcaacaggctgcaccaacatggcgccggcatctgtttctggggagggcctcaggaagcttccactcgtggagggaggcaaaggggcagcaagagagagggaggaagccccactcttttaaaacaaccagatctcttgtgaactgagaactcccttatcaccaaggggacggtgctagaccattcatgagggatccgcctccatgggccaatcccctcccaccaggcccacctccaacactggaaatcacctcccagcaggcccgcctccagcactggaaatcatgcttcagcgtgagactggaaggggactgatggagcctggatgtttgtccccgcccagatctcacgctgaaccgtaatccccaatgctggaggcggggcctggtgggaggtgactg

SEQ ID NO: 79135 - DNA, 970 bp, Homo sapiens
gttgcctttattatatccatttctgtattcgtaccagcacctcgcaaaataattgtctcagcagactcccttgggcaatacttcacagacatgactgtgcacgccagtcacccagagatcatgttaaaatgcacatctggttcagcaggcctaggtttctgtatgttatagaagttcaaagaagacaaactctagccaagagcagtgtgaagaaaagaagacgctatattaatcacagtccagggatgccttctggcttcctggcagcaattccggcctgagattccttctctgtgcatacttcctgtcaacattgtgtgatgtcaagctgtggccgtcacaaaagtactgtgaacacctgtaaatcccaactatcaaaaatcacacccaggaatccaaattagcattattatgtcaaaagaaaaacctgatttcttcactgtctgataactgctttctttattgtcctaaactagcattccctaacctttgagtgagatagtgacactttagtttcttatattctaaaatgttttcaggggcagctggtggcagaggagagggcagtggggatagggcagggagacagatacctgcacaaggaaggtatggggatgaggtgggagtcaagatgatgaacggagagagggatggtaaccgatttagtcacccatttgagagggtctccagacttgcactgctggctaaagactcctgtcctaagtgagaaagcatcatgtcaggcaagggctctatcccggtggttatgggtggacattctggagtgatctaaggaggctttccgagtctcactgttggctctccctgaccccttctaaaactttctttctagcttctgctgccctccaggtaagcactccacagcctgtggagctctgtgggtatagtctgtccttccataatgatttgcctcgctgcagtaattaacagaatgacttccaaaattaag

SEQ ID NO: 79136 - DNA, 426 bp, Homo sapiens
tctggaaagacaggccttttctctctgctttgcccccactaacttttagtgtttgtctagggttgtgaatccaggatgagtttttagcttccatttcattcttcttcctttcttctacgtagtataaattttttccactccaccccatttggttcaggggcctagatagtactaaaggcctaccataaccttctccctgtaataaccagggagcactcctttttcctatccatctattccttcattcatttgttcatttattccttgacatatgattttaacaaatatttgttcaacaccaatttatgggctaaggtgttccgtatataaatcccagttagccactgacaccaaagtcatggtttacagtgtagttacagagaaaagtcaacaattaccatacagtgtgataaatacagtaagtag

SEQ ID NO: 79137 - DNA, 1484 bp, Homo sapiens
gctagtcacctgggttaatcggccgagggagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcaca

SEQ ID NO: 79138 - DNA, 2126 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcaca

SEQ ID NO: 79139 - DNA, 3016 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgcctcccgggctggccctggcctcagaggctgttgcaaatgggggcccgtgtacccctgtacatcgccactaagggaaagggagcggcacattgtttttctgggaggggaaggaaggagtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctcagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagagctctggtgagttgggggtggcatacagccccaggatctcagaagcagatctcatcccatgcaactcagcagcacccctggaaagggggagatgcggaagaatgtatttataagtcattttgctggcagaaccctgaaataaatcctgctggtgacaaga

SEQ ID NO: 79140 - DNA, 2141 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagtaatctgagtctgctcctaactctttttgtttttcttcttctttttttct

SEQ ID NO: 79141 - DNA, 1960 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctcccggcggatcctctagatcacccgc

SEQ ID NO: 79142 - DNA, 2354 bp, Homo sapiens
ggtggcccgaaatcgacgccgtcacatgccgcacggtgatatctgtgctgttacggagctcttatgcctgactggtgccatgataatggcgcgtactcggtgagtacattgacgatcgctcacttgaggtctgagagtccgccccagtgtacaacatgccagttcaggttcactcgcgcaagacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgcctcccgggctggccctggcctcagaggctgttgcaaatgggggcccgtgtacccctgtacatcgccactaagggaaagggagcggcacattgtttttctgggaggggaaggaaggagtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctcagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagagctctggtgagttgggggtggcatacagccccaggatctcagaagcagatctcatcccatgcaactcagcagcacccctggaaagggggagatgcggaagaatgtatttataagtcattttgctggcagaaccctgaaataaatcctgctggtgacaaga

SEQ ID NO: 79143 - DNA, 1612 bp, Homo sapiens
ttcggcacaggctgaagtgggaggcgcgcggaagatctggcagactaagtgggccacagtccgggagttttcagggcccgtcctgaatccctccaaccctttccagaatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgcctcccgggctggccctggcctcagaggctgttgcaaatgggggcccgtgtacccctgtacatcgccactaagggaaagggagcggcacattgtttttctgggaggggaaggaaggagtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctcagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagagctctggtgagttgggggtggcatacagccccaggatctcagaagcagatctcatcccatgcaactcagcagcacccctggaaagggggagatgcggaagaatgtatttataagtcattttgctggcagaaccctgaaataaatcctgctggtgacaaga

SEQ ID NO: 79144 - DNA, 722 bp, Homo sapiens
ttcggcacaggctgaagtgggaggcgcgcggaagatctggcagactaagtgggccacagtccgggagttttcagggcccgtcctgaatccctccaaccctttccagaatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcaca

SEQ ID NO: 79145 - DNA, 1999 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcaca

SEQ ID NO: 79146 - DNA, 2621 bp, Homo sapiens
  misc_feature (2467)..(2467): n is a, c, g, or t
  misc_feature (2473)..(2474): n is a, c, g, or t
  misc_feature (2476)..(2476): n is a, c, g, or t
  misc_feature (2478)..(2478): n is a, c, g, or t
  misc_feature (2494)..(2494): n is a, c, g, or t
  misc_feature (2498)..(2498): n is a, c, g, or t
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgcctcccgggctggccctggcctcagaggctgttgcaaatgggggcccgtgtacccctgtacatcgccactaagggaaagggagcggcacattgtttttctgggaggggaaggaaggagtggaaggacgtcggaatnctgggnncngnaggggaccgtgggccnaatnggccaaaaaaggacttccaaggtggagcccctgtggtggtcctctgggctgaagagacctggggggggagaaccgggacacaagggggcgaccaggccggaaaaacacagggggggcccacga

SEQ ID NO: 79147 - DNA, 1925 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaaccctctgccgattcaccacccgcctctacctagccta

SEQ ID NO: 79148 - DNA, 2949 bp, Homo sapiens
acgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaagagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgcctcccgggctggccctggcctcagaggctgttgcaaatgggggcccgtgtacccctgtacatcgccactaagggaaagggagcggcacattgtttttctgggaggggaaggaaggagtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctcagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagagctctggtgagttgggggtggcatacagccccaggatctcagaagcagatctcatcccatgcaactcagcagcacccctggaaagggggagatgcggaagaatgtatttataagtcattttgctggcagaaccctgaaataaatcctgctggtgacaaga

SEQ ID NO: 79149 - DNA, 1140 bp, Homo sapiens
  misc_feature (954)..(954): n is a, c, g, or t
  misc_feature (957)..(957): n is a, c, g, or t
  misc_feature (959)..(959): n is a, c, g, or t
  misc_feature (961)..(961): n is a, c, g, or t
  misc_feature (965)..(965): n is a, c, g, or t
agcgggtctgcggctgcgttccccgaaagacgaggctgcgcccggattccggtccgcagggagaccgaagggcacagctccccgcgccgcgcacgccgcccgagcccggagtgcggacacccccgggatgcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgaaaaaaanaanananacanaacaaacaaaaataaaaaagaaaacacggggggagacaacgaagaaaagatacccccggaggagcgccaccagatgagggaccgacaacagtgttgctaccaggggcgccctatagacgaggagcaatacagaggaagaggaggacacggcagacaagagggacagcagaaaccg

SEQ ID NO: 79150 - DNA, 630 bp, Homo sapiens
cagccgcatttcagtatccgccgtctccagaggttcagtatggatctcaggcggtgcgtcctgtgccaaatagcaaggcactatatcaacaacccacggcgatggcgtttgatcttacggtaccacctagtggacaagatagtgcactgcatgagaccattgctacagccagaaaacagggagatcttgaggcatggcaatatccggtaatgttacaaccgatgccggccgggaaaggcagtcaagcaggagttaaacaatatggacctaactctccttatatgagaacattattaaattccattgctcatggaaatagacttatttcttatgattgggaaattctggctaaatcttccctttcaccctctcagtatctccagtttaaaacctggtggattgatggggtacaagaacaggtacgaaaaaatcaggctactaatcctgttgcttatatagatgaagaccaattgctaggaagaggtccaaactgggacactattaaccaacaatcagtaatgaaaatgaggctattgaacaactataagggctatttgcctcagggcctgggaaaacattcaggacccaggaacctcatgcccttcttttagttcaatcagacaggatcta

SEQ ID NO: 79151 - DNA, 692 bp, Homo sapiens
atgttaaccaaatataattcatgttttagagtgtcacttgtaaatctgatgtagtaggattcttttgccattttacatgtgccaaatcatataaactaagaaatagtttgatttttggttctaggacaatgtcataaatttggtattagctaaagtgctagtcttggggaaaaaatgaggtagtagtaaaatcaggaagctaatcttcaataggcacttaatccataaagagctgacttcccttgggtgtttaatcctggtcgactgtttctggtattgattattttccctgggttgtaaagtttgtaatgaaaagttttattctttggagatttgaaaaattgcttttcatgagtcctttatcttccaggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaaggtaacctctaatttagtttccttatgttttcttcagaaaaaaa

SEQ ID NO: 79152 - DNA, 432 bp, Homo sapiens
aatgacattgcatgttcctcattttctttcacagataaaaactggatacaacaaaacagtacagattccaattacttcagaaaacagtactgtgggtttgtctaatacaggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaaggtaacctctaatttagtttccttatgttttcttcagaaaaaaa

SEQ ID NO: 79153 - DNA, 843 bp, Homo sapiens
atgttaaccaaatataattcatgttttagagtgtcacttgtaaatctgatgtagtaggattcttttgccattttacatgtgccaaatcatataaactaagaaatagtttgatttttggttctaggacaatgtcataaatttggtattagctaaagtgctagtcttggggaaaaaatgaggtagtagtaaaatcaggaagctaatcttcaataggcacttaatccataaagagctgacttcccttgggtgtttaatcctggtcgactgtttctggtattgattattttccctgggttgtaaagtttgtaatgaaaagttttattctttggagatttgaaaaattgcttttcatgagtcctttatcttccaggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaagtggccagggcagaattagatgaagagccaataaagcaagtcgtggcaattttggatcctgtgagttctttgggatatgtgtgtttttttccgctctaaaataatattaattccaaattacgttagcaaaacatgatgtcccttaagaatagccctgcacatgaaaaaaatgtatttcccaaagaacgtcgacgc

SEQ ID NO: 79154 - DNA, 196 bp, Homo sapiens
agtgaggtttcccagcgcgcgtgtgtgtgtgtgtttgtgtgttttagattgtaattcttacatgcatttgtttggttttttgccttcacttttcctcccaacctggagctttatctctgcattaagtctgtgtagcaccaggtgtctcccagccccactatgtgtatgctagactgggcctgccggaccagcctca

SEQ ID NO: 79155 - DNA, 134 bp, Homo sapiens
agctagtaaacacatcgccacagatggtcacacaataagaccccaacccaaaaacataacctaacatgtaaagatgacagaggtttttgccaaaagttattttacgcttcagtaaggggaacagaaaactgttc

SEQ ID NO: 79156 - DNA, 620 bp, Homo sapiens
  misc_feature (289)..(289): n is a, c, g, or t
  misc_feature (293)..(293): n is a, c, g, or t
  misc_feature (298)..(299): n is a, c, g, or t
  misc_feature (314)..(315): n is a, c, g, or t
agcggttatagatgctaaatcaggtagtggctttttattccagcaaatatttctatctaaacaattggcaattctagcttatttcataagagttaactaattctgtagattattttctttttttttttcccaatggtgatagtctttatgataaatattgagtgtcctcatcttctcatccttatctggcttgtattatatgttcagaaaattacaaatttacccgttttcatttttggtggcattttctagtctaatttttttttttttttttttttttggagagagngggntcttnngtgttcccccccccnnggggtgtggggggctgttgactcttgggccccacgttgggccctccgcctcctgggttcaagcaattctcctgcctcagccttctgggtaactgggattacaggcgtccaccaccatgcctgcctaatttttgtattcttagtagagatggggtttcaccatgttgggcaggctggtctcgaactcctgagctcaagtgatctgcccatcttggcctcccaaagtgctgggattacagacatgagccactgtagtttaatttttttaatctaaatctcataaaacttcttcctctatttcaatta

SEQ ID NO: 79157 - DNA, 222 bp, Homo sapiens
gaaggttggagaggattaaattgatcacacttattaagggaaattctgttttttagattattgacttgctctaggtaaattacaagaggtgatcttgttcggattaagaatattcacagtgaatttgctgcctatcctattttaacgatcaatgaaaaagcttccagaggatggactccttggcagcctgtttatgtaagggttgttttttttgtttgtttg

SEQ ID NO: 79158 - DNA, 400 bp, Homo sapiens
ggtgaggaaggagaaatcaaattcaatgactttccctgggccaggcacaagggctaggcatttggtacatcattttacttaatttaatccctaaagcactcgtttaagacaagtattctttttgttggtttgtttttgagacagagtttcactcttgttacccaggctggagtgcaacggtgcgatctcggctcactgcaacctctgcctcctgggtgagttgctgggattacaggtgcctgccaccatacccagctaatttttgttctttttaggagagacgaggttttgccacgttggccaggctggtctcaaacccctgacctcaggtgatctgcccgcctcggcctcccaaagtgctgagattacaggtgtgagccaccacgcccagcctaagaca

SEQ ID NO: 79159 - DNA, 454 bp, Homo sapiens
gattacaggcgcccgccaccatacccgactaatttcttgtatttttagtagagacagggttttgccatgttgttcagactggtctcgagctcctgacctcaggtgatccacctgtctcggcctcctgaagtgctgagattacagctgtgagccatcatgcctagccaggtataggttttttatatatggcctttttattatcttgagatagtttgcttctattcatagttttttgagtatttttagcatgaaaggatattgagttttatcagatgttttttctgactcaattgaaatgattatctgttggtggacacttaggttgattccatatctttgctaatgttaacagtgtggctatgaacttgggggtgcaaatatccctttgatgtatttattttgtttcttttggataaatacctaacagtgggattgctggatcatatggtagttc

SEQ ID NO: 79160 - DNA, 336 bp, Homo sapiens
tgacatctgcatcttacattattaaatgcaaaggaatatcaaagactcctctgctagaaccatttttattcataaagtcacattatcattgtagaagtcttgtaaaaatgctacctgaaatgaattatgtccgtcttcccatctggcttacaaaattcttgaggaagcatctgcctcgtagctctttatctttctatttcctactacagggacaatgtatatggaaagataaatgtgtgtaggtgtataaattctcaataaatatttgctgaattagattgtacagttgttatcttttaagtttaactcatcctgagatacattttattattggtc

SEQ ID NO: 79161 - DNA, 442 bp, Homo sapiens
aaaaaaaaatcaaaggaaattgtttcattcaaattgttgagctttttgccatctttagaaccagtcagctagaggagagtgtttgtgacgattaccaagaatggttaaaaccaaaaggtgttggtttgcttgctctctcttctggtgagacagccatttgaaatagcattcaggcagcgtggcctggacgctgaagcagagcttggcagatggtaccgcaggatggagaaactgctggcagatggcatggactatttgagcaacaaagagacttttggctaccaatgctaagagttggaaagaaagaagacgacaacttctccagtgctgccagcttgtatacagaaaacgttttggcagaatggagactggtaaaagatattcaattgttaactgcaaggaaagagaagagttgttgttattaagtttcctaagtgtgctc

SEQ ID NO: 79162 - DNA, 280 bp, Homo sapiens
ttttttttttgcatttttagtagagacggggtttcactgtgttagccaggatggtctcaatctcctgacctcgtgatccacctgcctcagcctcccaaagtgctgggattacaggcatgagccactgcgcccggccaactttttgcatgttttctttaaaatttctctacttttaattgtacttctaatacagacacttctgaaatcagttttcacattgctgcagccttaccaatttgtagaaactgtttatgtgatgttttgattcttcatttatata

SEQ ID NO: 79163 - DNA, 666 bp, Homo sapiens
ccgtgttagccaggatggtctcgatctcttagtgagccgcccgccttggcctcccaaagtgctgggattacaggcgtgagccgctgcacccggccctagctaggacattgtcatgtcacagactgggcaaagagctggctttaccctgagtagaggctatttactaattgtcacttacggctggctagagttgacctgttttagatgccttagtgaagactatacagttgactgaacttatgcaattaaagttcgataggttctgaacatctttttacagatataaggaggctctgattttgtacttcacagtaactctggggaaaaccacgggattattagttccagaatttcttacagtggaaatacatagtgacttgaagtgatttgaattccccagagattgactaccgtgaaatctgatggcccaagaaaagatgaatgaaagattgtttttaggaacattagagagcaggactaaaacggctgcagactgatgttgagtcagacagacttggagaaagctgtgtgggactgttagttggagccttgggtttcctatacctacatgtaaatctgaacccaaaattctggtggccgagacacactttgagaaaaaagagcttgcctgagacacatgtcacactgagaccctaatcagggcag

SEQ ID NO: 79164 - DNA, 366 bp, Homo sapiens
ggagtttattgaagaatgttgcgagctcctacagctgtgatgaggtgggtgagccaagcccacttccaggaacggtgtcccaaatcaccccacaggacagtgggcctgatgggaaaccggcagcattgcagccaccgaacggggaaggcacccatcatatggggatgctcccacagcacagagaggtgcccatcatatggagatgctcccactgcacagatactcccattgcacagatactcccacagcacagagaggtgcccatcatatggggatgctcccactgcacagatactcccattgcacagatactcccaccgcacagagaggcacccatgatatggggatgctcccactgcacagatg

SEQ ID NO: 79165 - DNA, 353 bp, Homo sapiens
taatcatgattcaagtgactaggctgtagcacccaagaaccttgccttaaaacagtttattttacccaataatactactttgccttcttacttaaaaatgtcctgtgcttaacccttttgctctttattttgatttaagcacttgaccctaaagtcctgcttctgtcttacagaagattgttgtcatttaaaaaataaaacaatcagtactagaactagcataaatagtaatatctaacatgatcatttgtattatatagcatatttaagtaaaatgtgtttcattccattcagtatttcataaaaagacagcctctgaaaaatagttttactccttagatttctcatccact

SEQ ID NO: 79166 - DNA, 409 bp, Homo sapiens
ctctgtcgaaatgtcatctgcttaacaatgccaggctaccaactcatatgaatttaaacagtgatttaaattcattaaacagtgatattttcttgggaaaatatttcccaagaaaatgtctctcacctggtcaaatcattttagtttacacatttgtaaagaggaaaagccactgggttcaaatcactttctctaaccctatttccacctgactatcttaaagcaaacaccttcatcttttcacatcctacatctcttcattttcccaggaccctggagggtcaaggtttagaagtttttggagattcccaacaaaagcccctttcattgttgctagtataattttaaaggaaggatgactaactgaggccatttatcacagtttctatactgctagtgaggcggcatt

SEQ ID NO: 79167 - DNA, 374 bp, Homo sapiens
tcagtgatagcaccaagacttttggcccaaggaactggaaagatggaaatgtcaatgacagaatgtggaggatttcgcaagcagcagagtgtaggagaagcaatgcccttggctcatctagggcaaagggttgaattggcaactggaaatagaagtcaaattcagaagagaggtttatgtggacatctgtgtttaggtgtcaccaatatacagctgatactttttaaaaatctagtgaaattatcaaagggttaaatgcagagagggaagaaagtaggtccaaagatcaagccttgggacattggaagtttagaaataagaaagatgtcattgtcacttgtaattttgtgctagtcactgctctttttctttgt

SEQ ID NO: 79168 - DNA, 187 bp, Homo sapiens
ggctggggtaaggccaggaaaattcaacaggcactaaaaatattgtcaagctgctgacagcacagccagaggccccaggcctgggtggcatccagacagccctgtcctttctagacagccccctcctccaggctcagggacctgtctggctgtgagctcccaggaggtcccaggggtgtgacctccc

SEQ ID NO: 79169 - DNA, 887 bp, Homo sapiens
agcgcgtgtccgagcggcttaaaggggccgtgctgctgccttcgggtaccgctgccccgggagacccccggcggcccggccctgcggggaccgggcgggatggggaccggggcagtggaccctcggagttgggatggggcggggggaacgcgggcgtggagccctccggggacagggtaaggttgggtaaccgtgggcgggggctcctccaggggcgggggtggggtaacggcgggcggggccactcaagcgacagggcaggggcgggaaggccgcgggcgggggcggtccctccggggacggggcgggtgggggcaccgcgggcgagatcgcttcctgcagaggaggcaacaggccccgctagcaggtcagggtcccgggcaggcgcaggtgccccccggcctctcaagcagggactgcggcgagctcagacgcggctgacgggcagagagagactcgcgcttgggctcagtgcgtgtgaagtgggcctcgggctgcggaggagggcagcaccccgtggctcctcgcgctgctgcgagcagggccgcctggcaggggcgggggccggtgggcgggagtgtcggggtaaggccgcggactcctcccatgccgctgagcagtggacagcggggactggagacctccaggtgaggaaggggaacgaagtcaagaaggccacatgtcctggcttccaggcttggtgtcctcagaagcctccagaacgtccatggaacccgccctgcgcccaccgcctcctgctgtctttccagctgagttccggctgccctcaccctcggcttcttcactctgcctctccccagccaggccctgctcccggtcctcaaccaccacttcacctgcctgggcttcatcgctccgagctcccc

SEQ ID NO: 79170 - DNA, 279 bp, Homo sapiens
cacagatttaagttactttgcagactcactgtagtgaagatttaaacactgtgtaccagattcaaaaattagtgtgtaccatcagataaagtgcctgacatgatagaggctcaccagatattaggcaatgtatatgcagaaaaacataacccaaccagccatatgtttatagccacagttaaccactaaattgtttccattgttacaaacatatatcgggctatctccttttcctatggctaaataattaagtttgattttcttagatctccctttctt

SEQ ID NO: 79171 - DNA, 761 bp, Homo sapiens
acctgcctgggaatatgtggtaggaacagcagagtggagagagagcgcttgaataaggtgtcttgttgggagacattccccacaccatggtgccatgggaatcacataagcaggtcaagtgtgcctcactcaagcactcaggaaccaagcttgcagagggggtcagggcaggaaatgcacacgactcccagccaaccccacactctggacctggggcacctgctaagcactttctctgtaagatctcacttcaacctcccgtgaacagccctataacgtgggtgctatcaccttcttcattcttctacagaaactgacaaacgcagttaaaccaggctaatttggactgacgggctgggtggggacgtcatcagagagaagctgcaggagggaaattgtagactagaacaaagtctgaagagggtggagaaaagcacagattaaaaaaaaaaaaagaagaaagaaagaaatgtggccaggcatagtggctcacgcctgtaatcccagcactttgggaggctgaggcaggttgatcacccaaggtcaggagtttgagaccagcctggccaacatggcgaaaccctgtctctactaaaaacgccaaaattagctgagtgtggtggtgcacacctgtaatcccagctactcgggaggctgaggcaggagaatcgctcaaacccaggagtcaagagtttgcagtgagctgagattgcgccactgcactccagcctgggcggcagggtgagactctgtccccgcca

SEQ ID NO: 79172 - DNA, 806 bp, Homo sapiens
ataaagagatcatctggaactgcaatttctaactcatacatcattgctacaaaccttatttgtttactgtttctcttccagggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttagcatctaaaaaaattaaatcactgctaatgcaattaaaatgcattatgaaatgcacttctgtccaggctggagtgcagtggcacaatctcggctcactgcaagctccgcctccctggttcacaccattctcctgcctcagcctccctagtagctgggactacatgtgcccgccaccacgcccggctaattttttttttagtagagacatagagtttcaccagattggccaggctggtctcgaactcctgtctcacgtgtctgtgtgaagagaccacccaacatgctttgtgtgagcaacatggctgtttatttcacctgggtgcaggcgggctgagtccgaaaaaggagtcaacaaagggtggtgtgattatcactggttcttatagatttgggtatagcgtggacttaagagcagtttttcggggcgaagtgactagacta

SEQ ID NO: 79173 - DNA, 523 bp, Homo sapiens
ataaagagatcatctggaactgcaatttctaactcatacatcattgctacaaaccttatttgtttactgtttctcttccagggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttagcatctaaaaaaattaaatcactgctaatgcaattaaaatgcattatgaaatgcacttctgtccaggctggagtgcctcttcatttttatttctttattcagcaagtattgatcaaatgtgctttgtaccaagtactgagctcttcgttgagatataat

SEQ ID NO: 79174 - DNA, 318 bp, Homo sapiens
ctccacccgacggggtggcttagaattttatttttggttacatctcaactatcacagcagccgggcgcggtggcttcacagctgtaatcccagcacatccagctaatttttttttttaatgaggcggagtctcgctctgttgaccaggctggagtgcaatggcatgatcctggctcactgcaacctctgcttcctgggttcaagtgattcgcctgccttgctgggatgacagacgtgcaccacaatgtccggctaattttgtatttttagtagagacatggcttcaccatactggccaggctggtcttgaacttctga

SEQ ID NO: 79175 - DNA, 440 bp, Homo sapiens
cagttatctactatcagttaatgtagagctgcttcattctttcttagcagtcgcatgggtccatgatatggttgtgttataatctaattacttagatccccatatttggacatttaggcagtttccaatctttgagcatacattttgatcccaattgaaatttcctttctgccccctctagctaattaacatccccaagcctcagttttcccatctgtgcagtgggaataattatatgtacctttcagagttgctgtgagtattagaagtgatgcagaaatgaagcactgcccagcatgaggctcacagtaggttaatattgatatgcgttccctgaatttctgattgcggtgctgagctcatcttgcgcacctgatgaaggctcgtgaatgactttgtttccagtttaaaatacagtagaatcacgttaattttttctc

SEQ ID NO: 79176 - DNA, 772 bp, Homo sapiens
ggggtcggagtgggcagcgtgtccacagccagtgagtgctggggtgaggcggagacctggcccttggctactggtggagtatgccggccgccacagcaaggaggaccagtgcagacacaggcacagacacgcacactaatgtgtatacgcacacacacatacatgcagacacactgatgtgtacacacacaggcatagtcacactaatacacaagtgcatacactatcatgtacaaacaggcatgcagtcacaatgtgcaaatgcgtgcagacacactaacatgtaagacatgcatagtatgtgcacacagacatgcacactaacgtacgtggacgtgcacacaggcaggtacacgtccaccggcaggtgcgctgacaggtacatgcgagcacgcacacaaacagacatccgttaagtgtgctcccggggacgtcacagtaagccacgcacatctcacgcccgcactgcccagaagaggtcagggccgacctccagatcttcggagggcttctcccagcccaaccccgagaaactgctgggccaagagagtcaatgccatcccagacgcacgccacacatgaatacaaagcccacgcgttgtccattctggcccaccttctcctgaccctacaggcctgtggggacctgcccccgccccgaccaaggggaggcaagccccggcgctgggaggaggcacaggtgccactgagggtccccgagtgtgtgtgcctgtgcatgtgtgtgtcaaaccctactcctgggtctacgtcg

SEQ ID NO: 79177 - DNA, 821 bp, Homo sapiens
  misc_feature (10)..(10): n is a, c, g, or t
  misc_feature (27)..(27): n is a, c, g, or t
  misc_feature (33)..(33): n is a, c, g, or t
  misc_feature (674)..(674): n is a, c, g, or t
  misc_feature (821)..(821): n is a, c, g, or t
cctatgctgnaacgactctcttaatcntccacngctacacaaacttgttaatttaatacaatttacaacacacctgctggcactttgatcttggacctccctgttgtctgaactaggtaacctgacctctccactgaagggcgtgtggctttctgatgacagtaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttgnaaggcaaagcatttgcggttgaccgagattaaaatccttctatatttatccaaacagaattttattgtgggccaaagctgaaaaagattagcgaatttgctctcacacaaaatttctaatcatttttgtattcgcggcccccactan

SEQ ID NO: 79178 - DNA, 907 bp, Homo sapiens
  misc_feature (748)..(748): n is a, c, g, or t
  misc_feature (762)..(762): n is a, c, g, or t
  misc_feature (764)..(765): n is a, c, g, or t
  misc_feature (772)..(772): n is a, c, g, or t
tgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacatttcatatntcttaaatagaatntnntgatgcnttaatctgaaatgaattatgtattggtcggtcacaaatgctaactcatttgaataggtggccattctagacagactcctaattggtcgggccttggcacggttgggggcaactcaaagggggtgtgagcctgaag

SEQ ID NO: 79179 - DNA, 563 bp, Homo sapiens
gtaatacggtcccagaaaaactacaggatggactaaccctgcttattcctgtgaatcaagaggtgatcttctgcagcttggaaaaaaaaaagcgatggaatctccctctgttgcccaggctggagtacagtggtgcgatcttggcctacttcaacctctgcctcccgggttcagcgattctcgtgcctcagtctcctgggtagctgggattacaggcgctcaccatcatgccttgctaagttttgtatttttagtagagacggggtttcaccatgttggccaggatggtcgtgatctcctgacctcgtgatccgcctgcctcagcctcccaaagtgctgggattacaggcgtgagccaccacgcccggccctttaatcatttttatgaactgaaaaccagtgtcacttgtcaaaaataaatattgaacccaaatataaatataatgaaaacaaaacgatgttgttaaagcttaactacagacatttcccaactaaagtatgaacctggatcccgggtctttctttccaaagacattaaagacagactagtgccaaaaaaaaaa

SEQ ID NO: 79180 - DNA, 236 bp, Homo sapiens
gtaatacggtcccagaaaaactacaggatggactaaccctgcttattcctgtgaatcaagaggtgatcttctgcagcttggaaaaaaaaaagcgatggatggagtttcactcttatcacccaggctggagtgcaatagcgcaatcttggctcactgcaacctctgcctcctgggttcaagcgattctcctggctggcccagagtggtggcagtggaggcagggagaagtgttcaca

SEQ ID NO: 79181 - DNA, 147 bp, Homo sapiens
tttttcttgggtagatatgcaatagtggaattgtcagtttttggtaagtttatgtataactcaaagaaactatcaagctgtttttaaaagtgcttgtcacactttacattcccaaaaacaatgggagtgtccagttcctacacattg

SEQ ID NO: 79182 - DNA, 460 bp, Homo sapiens
aataatttcagtttaatacttaggtcctggaataataaaggacaggtgtggacttatttccaacaaaagtatatttacccttgttttcttagaataaaaggacattcttacataaactgcaaaatattcagaaaatgatgaaatttgagtctgcatgtgcatgtcacagacgtaaatgtaaggattattttgcaaaaattggattgtcaaatacattgggttgattttaattttgaattgaatatactacaatgccaaggtttagggggatgtaagggggtaacaggtaaaataagccattttaagcttaacacattttcaaagaccctaacaccaggtaatggtaaggatgcattgaagtgtgtacattgtgcacagttctgaaagctagctaggaaatgggaattaacccatactgttcaacttttattggtaaagaaatagtaactgggtgaagggt

SEQ ID NO: 79183 - DNA, 250 bp, Homo sapiens
aactctagccaattagtgtcctcagccagcaatgtacagagaatcatattttgtttgttggtgaaaccattcctttctaaatcatgtctgcttttgggggttgatttgcttattactttattgttaactgttatctctttgtttgctctcattatgcctgcccatagtagtctcctctttataatttgatgttttcagtgtgctgtgggaacagaaccccatacagtacttgctgaatggtggataaaaa

SEQ ID NO: 79184 - DNA, 335 bp, Homo sapiens
gtggcattcactcatttgcacaaggcagctgacaggttgtggatttctatagacttggggtctaaaagtagaagtcctgagaaacacactagagtttgaattggaatccccaaaggctacacactagaaaaaaagaattagagatggaattttcctcaggacgaaagcccagactgtaaagatgttaacccttgtctaaattaagaatatttgccttcttcctaactacctgccagaagcaaaagtgaatccactctggaggaagacaaagcatctagagcttcaaattatctgcacacctagtattggaaatatgaagtattgagccaaaaatt

SEQ ID NO: 79185 - DNA, 999 bp, Homo sapiens
gcctctccctgcatccttgtgaattttgggcctttttgtctaatgcaaaaagctatgagcacagataagagactcatttcaatagccagtaaaagcaaacagcacaaagaaggtggcagatgcacagaaccctattcaaatccaaattaaaatggctgtgaattaacaagttggctttatccgcccttctccaaatagggcttataatgagccattaacaggctgaatagtatgagatccattggtgttcctgtctgcatagggtggatcacagcagatacccagaacgtcataggatcaaaatctttccataatcaaagtggaaatgtgaagaattgttcagtcaatcttattcatcctacctttgtaactgtcttcatatatttctcctctttttcattcacatagctactaccctgagctgtagtagcttcctaatttgattgcatgcctttggtctttccttccttccaatccaccctgtcctttattgctattcatctttaaaatgctactttggtcacataaccacccagatcaagaactttaatgattttccaatgcctttaggataatgctccacaactctacagctgtgctaccctacctccccagttttattttcaattattattttatgcaggctttatgctccagctgaatggatgtattctctgagcctctgagagatacatcatattcttttttgtctatgtgccttttttcatacatttctctgcctggaatacccttcccttccctctagtttgtgctttttaagaggagcccctcctttccactctagagcctcctcctctatgatccttcccacataccaggatatgatccagctcatccctgcactacggcccttgtccgtataacccttcacctggcacagaccatctctcctccagtaatctatgcaatgttattgcctatataagccgacaggatacttaaagacaagaaccacactattcattttgagttccctag

SEQ ID NO: 79186 - DNA, 863 bp, Homo sapiens
tcttctggcggaggagaactgtcattctgaggggctggggtagggaaagctcttcaagtgcgaatttccccattttaggcctctctcctggcccccggacatttttttacctttttcttcttccgtaaacttcctgccagtgactagcttccggtatgaaatcaagctctgcgtgagagctgtaaaaccagaaaaatgtggaaatggacaggagggctgttgtccaaaaatgcaaaggaaatctgacgtcccaccctgaagaaaaatatcacaaggcccaaaagcaaggcgtctctgatgagtcacctatgacacccaattgaaatagcatcgccttggccgggtgctctggtttccacagattaacttggtctggttacagcggctgcttaggatcttcaactcccactggtgccttgcttttctagcacacccagagaacacctgttcctcacgtgaacattacaaggggatccaagatgctttactttttgctcttgggaaatggaggggatacaatactaagtattccggaatttcctttgaaaaaataccggaatgccctgagcccggagccagggatgattactgaagccctggctctttagtcactatatgtgagaactgacataagacctttcaacccctgagcgcttagatccttcatctgtaacgtgaagtaatagtaatccgtactccatggatttcataggctgcaaccttttggaaagaaaatcaaaattttactgttgacgaatttttatttactcatcttgtgtttctaacatctaacggggtgcctggcacattatagatgtttcatattttaaaaataaatgtaaggtgcaaatgagctaacattg

SEQ ID NO: 79187 - DNA, 820 bp, Homo sapiens
tcttctggcggaggagaactgtcattctgaggggctggggtagggaaagctcttcaagtgcgaatttccccattttaggcctctctcctggcccccggacatttttttacctttttcttcttccgtaaacttcctgccagtgactagcttccggtatgaaatcaagctctgcgtgagagctgtaaaaccagaaaaatgtggaaatggacaggagggctgttgtccaaaaatgcaaaggaaatctgacgtcccaccctgaagaaaaatatcacaaggcccaaaagcaaggcgtctctgatgagtcacctatgacacccaattgaaatagcatcgccttggccgggtgctctggtttccacagattaacttggtctggttacagcggctgcttaggatcttcaactcccactggtgccttgcttttctagcacacccagagaacacctgttcctcacgtgaacattacaaggggatccaagatgctttactttttgctcttttgaaaaaataccggaatgccctgagcccggagccagggatgattactgaagccctggctctttagtcactatatgtgagaactgacataagacctttcaacccctgagcgcttagatccttcatctgtaacgtgaagtaatagtaatccgtactccatggatttcataggctgcaaccttttggaaagaaaatcaaaattttactgttgacgaatttttatttactcatcttgtgtttctaacatctaacggggtgcctggcacattatagatgtttcatattttaaaaataaatgtaaggtgcaaatgagctaacattg

SEQ ID NO: 79188 - DNA, 593 bp, Homo sapiens
tttttaaaattttttgtggagacaggctcttgctttgtggcccagtctggtcttgaactcctggtttcaagtaaacctcctgccttggcctcccaaagtgctgggattacagccataagccaccatgcccagccacttcccacttctctagacactcatttatcttcccatcaaactgtggctgaatttctcaaataattgtcttgtgacctttgaacagtctccctaaatgtaaatattgcattgaccaacaatgggaatgatggcagcacattctcaccaggcaatttcagagagctgctgtataatttttcttgaagcactggctgggaatacataattgggtggaaatatactttgcttctgaaatgtgtggataaagtcatttttatttttgatgactggttttgttttaattgtgaagaaatccttaggttgatctgtatcctggcaatcatttaaaaattttcatgttggcggggcgtggtggctcaccacctgtaatcccagcactctgggaagcttaggcaggaggatcacttggcccaggaattcaagaccaacctggacaacatggtgatatccctttctta

SEQ ID NO: 79189 - DNA, 422 bp, Homo sapiens
gtttaaatggagtccacagttttagcatggcctgcgaggccctcaggaaacttacaatccatgtcagaagaggaagcaaacacatccctttttcacatggtggcaggaaaacgtgcagaatgaaggtggggtaagagccccttataaaacccatcatatctcacgagaactcactcactatcatgagaacatcatggaggtaactgcccccacgattcagttgcctcccacccaggtccccgcaacgacatgtagggataataactacatttcaagatgagatttgggtggggatacagccaaaccatattacatacaattttaagaactgagatcataaattatttcagagaaaccagaatacatagcatgctgtctaaattgataggtgggaaaacttaggtcagaggattctaaatatc

SEQ ID NO: 79190 - DNA, 310 bp, Homo sapiens
cttccaccagggtcctcaggagcctgagagtgtggtgaaaagggcagcctggtcactgtattgatttctattgagggctggaaaaaaactccaaaagtgcaaaggggagggagtttccctacatatgcttaaagccataacttggcaattccagagacctttgcaaagagaaatccctctttccaggcgcatcactggagaggaaggccctgcggggtgaaggcccaggaagctgggtaaccaccagcttcctgggcatcactggagaggaaggccctgcggggtgaaggcccagaaagctggtggttac

SEQ ID NO: 79191 - DNA, 385 bp, Homo sapiens
gttcccccttccccatcacagtcccagcacctcccttcttccatcttaacttttataagtaataatttcgttgagtttctttattgttttgtcacccagatgtgcatccctacatgctatagtcttactgtccttttaaaaaaacttgatacatcttttaagtctcttttaatctaaagggtcccctccatccctttccttttcttacaaattgttgaagattttaagccatttgatctgtagattttcacagcctgggtttttgctcatttcatgcccgtggtgcagttcaatatactcctttatcctcagcatttcctgcagatcagcagctagatctagacaatttgcctcaggttgatccctttgataagactctaggtag

SEQ ID NO: 79192 - DNA, 828 bp, Homo sapiens
atgttctgacaatcagctccaaaaagagaaaaaatatctttggaacaacttttatttgtgtgagtttatttaataactttaaattatacacttactataaagtcagtcatttcagttgggtatggtggctcacacaatcctatcgtggccccaatccctgttggactgaacaaagggagacgaacgtgggaataaaaataaagacaaaagagtatatttggaagaaggggtcagggggctccttgctccagtgaacaagggtcctgagcttttagcacccttcgtatttattgagtaaaggagatagggaggaggtggttgtcagtcagctgcttgactcggtgcaggcttgcacaactgcattctctgaacagtagtctccagatgttccagtagataacctcaaggagcacggcgccagagagtgactgccctcagcaaaccttctggcggcaggtgcagatgtgagtttgcctacatcctgcattcatgataaacagtttgctgtttgatcatatagcctcagtggaatgctaagttggtcacgatcctctggctttcggctctctacataatcccagcattttgggaggctgaggcaggtggatcacttgaggccaggagttctagaccaacctggctaatgtggcgaaaccctgtctctaccaaaaatacaaaaattaactgggcgtggtggcacacacctgtatcccagctactcaggagactgaggcaggagaatcgcttgaacccaggaggtagaggctacagggacctgagactgggccactgtactctagctttgatgacagagcgagaccttgtatc

SEQ ID NO: 79193 - DNA, 477 bp, Homo sapiens
gtcatgaactggggggagccactactctgtttttaccctcattaaggaactttattgtgaaaggtaaaatcactttgtaaatgtgaattagaatagaaaatggaaattccttatatactctctaagccactggaaacttgaggcagagaagttttaaaagacgcacatggatttcctctgaaatatttgtaaacaccaaattcagaacatgttggttagtttaggaccataccaggctttagttgttacattgaattgtaaataacttatattcatgagcctggaattaaagaaattcttggtatgagaatttgacaactacttctggcttccaggagccagaacccaccttcgaatgggattttgaaataagccccgttgaagagacacacagatggcagaggccgcagcacaggctgtgagaccttcttcaggtttcggtagactgtcttcattacggcgtaaaaacatgtcaga

SEQ ID NO: 79194 - DNA, 197 bp, Homo sapiens
aacatggtgaaaccctgtctctactagaaatacaaaaagtagctgggtgtggtggtgtgcgcctgtagtcctggctaactcaggaggctgaggtgggaggatcacttgagcccattcgtgcgccactgcactcctggggcacagagtgagactctgttagaaagagagagagagaaagaagagagagggagggagga

SEQ ID NO: 79195 - DNA, 349 bp, Homo sapiens
ggataatgcctggaaacatacagactcctaaggttgaaccaggaagaaacagaaatcctgaacagaccaatagtgagtggtgagcttgaatcagtaataaaaagaatctcaacaacagaaaagcccagggccagacagattcatgccaagttctactggacatgcaaagaggaatcggtaccaatcctactgaaactgttccaaaaaatcaaggaggaggaaatcctccctaactcagcctgcaaagccagtatcaccctgataccaaagctaggcacacagccaaaacaacaactacaggccaatgtccctgatgaacataggtgcaaaaatcctgagtgaaatacta

SEQ ID NO: 79196 - DNA, 388 bp, Homo sapiens
agaatttccacattctacagatgaggaaaccagggaagagataggcaatatcagagacaaaatttgaaatcatagctaaaagagactgtctcagtcattaaagccacaatatgtcagatcagaattgcctctctaggggtctagagagcagcaacaaccagaagatggcctggtcttgggacttggattcaagagaagtgttcccccaaggcaatgacaagcaagagttaaaaagtgaatgtgggctcaagtgttttgggaaaaataagcattttacaatctataaatcatgtctaaatgacaagtaaaaagagaagaacaggctaaaaataggaaaataaacatgcagagaatatgtattaactgaataacttttgtggggaggtta

SEQ ID NO: 79197 - DNA, 743 bp, Homo sapiens
agcgtggtactgctgggtcatatagttaagtgtatatttaaattgaaaacaaactatggctgggcggggtggctcacgcctgtaatcccagcactttgggcggccgaagcaggcggatcacaaggtcagaagatcaagaccattctggccaacatggtgaaaccccagctctactaaaagtacaaaaattagctgagtgtggtggcgcacacctgtagtcctagctactagggaggctgaggcaggagaatagcttgaacctgggaggtggaggttgcagtgagccgagattgcgccattgcacactccagcctggtgacagagggagactccatctcaaaaaaaaaaacagaaactatgaaaatattttccaaagtggcaaaatcaattttgcattccatttgcttcttatcctcaccaaagtttggtatcgaaaatgtattttccaaagtcttctcaatatataagtgggttgtttgtttccttattagcaaattgttagagtgctttatgtattctggatgcaaattcctttcagatatgtgattagcaaatattttatcttagctgtggcctgccttttcattctctaaacagtgactattgaaggggtgggttgcccctccacacctgtgggtgtttctcataaggtggaacgagagacttaggaaagaaaaagacacagagacaaagtatagagaaagaaataagggggcccggggaaccagcgttcagcatatgga

SEQ ID NO: 79198 - DNA, 349 bp, Homo sapiens
caacctctgcctcccaagctcaagtgatcctcccacctcagcctcccaagcaactggaattacaggcccacgtcactatgcccagctaattttttgtattttttgtaaagacagtgttttgccgtgtggctcaggatggtctcgaactcctgggctcagacaattcagccacctcagcctcccaaagtgctgagataacaggtgtgagccaccgcgttaagccatggacaagttatcagacctttctatgctttagtttctatacaggtaaaatgtggccagtgacagagtttttgtaaggattaaatgagttaatatgctaacaacacttagaactatgcctgacagc

SEQ ID NO: 79199 - DNA, 317 bp, Homo sapiens
tccagagaattggaggtaggtgtctttggaggatcattcttttacctaccacaggtgctaattaaacatttttaaaactcagctggttgtttcctttccccatctctgtctctgagtatttatggaccaggttttcaaaacacataactcacttccctgttataaagtaataaatgttagaaaatttctctcagttctttaaaacagttgggaaatgattaaattgtctttgcagtgattgtggcttattactctgaaaactggacttgaactccaggtatgttgggtatcatcctagggaaccactaacactctag

SEQ ID NO: 79200 - DNA, 1614 bp, Homo sapiens
gatcccttaacacttaatggatggtctctcagggtagaggttggaattttatgagtttgtgaggaggatgggcattactgatgatctcagggacagcactactcatgctggacccccgggtgactgctaaatgatgataccacttgaggtaaaaagagggagaacgttttaagcaaatttttaatacaaaggattgagtcaggtgtgctatttctagactagactgttacgtggaaaaagtcctaatttctaaacctctctttttgttaaagtggttatggccatgggaaaaagtttggtttggatttgcttggtttctgggttgcaattacagctttttgatccaagcgtcttatggacacagactagaaacttcccatgcaactgggatttgaatttcggcaacatggttgcagctgttttgaattaattattgtgagtcttttattttttaaaggttattaggtggtagtcatagctggtaggaaatcaacttggggcctcttcagtcactattttgacactatgtggcattttcatcaaagtggagacaagggttggtggtccttgaatggctgctgctcttgaaacaaatggctttttaacatggcctcagggcggctgcatttttggaactgctttactttttaagggttaaataaagccgctttgtacaactgtcccttggctgtgatcatttttcagtttgccccacaggagtacatactctaaaagtaaattgtactgatccctcatatttccgttcttcatttctttgcactgatgattctcctgttttgtacaaagtgtcagtttcgttctgaaacatttcaggagaggacaaagagggtgaggctctagatgtaaactttggacacttggctttcttgccttcaaccaatgtgcagagccattaataaatatgtccttcagatctttaaattttttgtaaaataattttaccttgtttttcattaaaaatttttcttcctatagcctcataattttaatgtcctttaaacaaaagagttggaataggcatgacttgttgaggccgttaagcgggttatttttacccttgtactgctaaaccaaaccgatccagaggacaacaaaagcccattttttgcctttggagagtctggttagagatagttttctccagggtaacactttacatttgttttctgtgtgccatcttcaagttcagcagccattttggtggttgtcttgatggattgtaacatctggtcatggtggtcatgaattggcaatccaaaccttgaggaaaatctgcagaaacttttgaaatgctttggttttttcccttttgtgtagattagaatcatatgagtctgtttaactgtttagatacaaaatctgagccctaaatttgaatttatttgtgtcctttaaatggggaggtttagaaagcggcaagaatgaagcctggcctaattcactgaagagaatccagatgctgctctggttttgtgatcttattatattcaaacattctgcctctacagatgtggagcctagtgctgtgtgcaggaccagctatagaatttgtggggcccaacacaaaacgaaaacaaggggcctcttgttaaa

SEQ ID NO: 79201 - DNA, 215 bp, Homo sapiens
aaagcccacagtgagctcacaactcaagtggggctgcagtgatttggaccttctcagcctttctcatgacatggcagggctgctctccgctggcaaatatggtctcggtctccctcaacatcctcttcccccagacgcttagagtggagggccctgcccaagggatttgcatccctttgcatgtcatttacaagcctgctgcccttgctgcctct

SEQ ID NO: 79202 - DNA, 574 bp, Homo sapiens
cttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaaggtaggctgtggggctctggcagcctactgaggggaggagagggagacatgggcttgagtcctgggaagttcctggttaggagcatggaagtgattacccaatgtgggggtggggcagggaggctgtactatgaaagcatcacagcccaatactgaggtgcaggctgtactcttaatgcgtcatggtgaaaatgtccaacaattattttcctagaggatttgaattgtgcccaggaaatctggggcttagcacaaagcaagggtaatgggaattttgcctcatgctcaaaaatgtacctctaggggttgagacttaagggg

SEQ ID NO: 79203 - DNA, 789 bp, Homo sapiens
aggccaaggtgggcagatcagttgaggtcaagagttcgagaccagcgtggccaacatggtgaaaccttgtgtctactaaaaaaatacaaaaattagctgggtgtggtgttgcacacctgtagtcccagctaactttgggaggctgaggtgggcggatcaccagaggtcaggagttcgagaccagcctggccaacatggtgaaaccccgtttctccccaaaaaatacaaaaattagctggtcatgagggcacacactgtggtcccagctactcgggaggctgagggggaagaattgcttgaacccgggagatggaggttgcaatgagtgaagatcgtgccactgcatccagcctgagcaacagagtgagatcttgtctcaggaaaaaaataaatttaattgctgtggatactgtaaagggtgtttatcgtaacagttcataatattctatttaagaatgcgtgggagaaattttctctggacccagttatgcttttcctgaattgctgtttggtttttaccttaaggacactaaatattcagctgattgtatttttctgtttgtactgatactagaccatttagagcccaatttgtggtctaccttcagcaagtgtttatgtattttgtatgctagtcatgttcttggttctgtcttccttttctacttttattttccttattctcatttttctaagttttaatcgttttatattactataatatctgcatcttgtaagcctttttgtaataaggttgggatataaataaataaggcaatgtatccttta

SEQ ID NO: 79204 - DNA, 753 bp, Homo sapiens
gtttatctgctgaccttccttccactattgtcctatgaccctgccaaatccccctctgcgagaaacacccaagaatgatcaataaaaaataaaataaaattaaattaaaaaaaaaaaaaagagaggaacccacaaaaaaaaaaaaaagaaagtatataaaataaaatattgaagtcctttcccattaaaaaaaaaaaaaaagaaaaagcacggactctttcatccagttctgatgtgattatctctggaaggcattttctcctcctcttccctccacctccattcagagtcactgacttataccttttacatattcacatgaaattcacttaatatatacacctatatactcacaaaaattaaaaattaaaattaaaaaaattcctggcccggcgcagtggctcacgcctgtaaatcctagcactttgggaggccgaggtgggcggatcacgaggtcaggagatcaagaccagcctggccaacatagtgaaaccctgtctctactaaaaatacaaaaattagccaggtgtggtgcacgtgcctgtagtcccagggaggtggaggtgggagaatcgcttgaacacgggaggcggaggttgcagtgagccgagaccacgccattgcactccagcagccagggtgacagtgagagtccgtctcaaaaaaatagcttgggcctgggaggcagaggttgaagcgagccgagattgtgccactgcactccagcctgggtgacagagtgagactgtctca

SEQ ID NO: 79205 - DNA, 761 bp, Homo sapiens
ggcgtctcactcggcgcgaggagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacactgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattt

SEQ ID NO: 79206 - DNA, 709 bp, Homo sapiens
aaaaaaaaaaaaagatttaaggttagagacatatctcaataaccttttcctttagtaaggaaaatcatctggaccttaaatttgtatacagttttggcctttatgacttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagcaggctggtgtggaactcctgacctcagatgatccacccgccttggcctcccaaagtgctgagattacaggcgtgagccaccacgcccaggctctcatcttctttaataagtcattttaacctctctggatcttagtttcctggtgtataaaatgagggtaaaataaccactggttcttaattgtggggtatgggttcagatttctgtgatgctgaaatttatttatttatataaataaataaggcaatttattcatatcctttcttttctttccccttcccctttccttttctttaagagatggcatttcgccatgtagcccaggctggtctgaactcctgggctctagtgatccacctgctttggcctctcagagtactaggattataggtgtgagccactgtt

SEQ ID NO: 79207 - DNA, 778 bp, Homo sapiens
aaaaaaaaaaaaagatttaaggttagagacatatctcaataaccttttcctttagtaaggaaaatcatctggaccttaaatttgtatacagttttggcctttatgacttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggctcacacttgtaatcccagcaagtgctgagattacaggcgtgagccaccacgcccaggctctcatcttctttaataagtcattttaacctctctggatcttagtttcctggtgtataaaatgagggtaaaataaccactggttcttaattgtggggtatgggttcagatttctgtgatgctgaaatttatttatttatataaataaataaggcaatttattcatatcctttcttttctttccccttcccctttccttttctttaagagatggcatttcgccatgtagcccaggctggtctgaactcctgggctctagtgatccacctgctttggcctctcagagtactaggattataggtgtgagccactgtt

SEQ ID NO: 79208 - DNA, 2420 bp, Homo sapiens
cttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatgggtgagagaggttaaagctgatgggtaagcattgggcaggaggatagctaaaggatgtctgtgatgagtatctttgaaatctgtagccccagaggtcctaagtggaggaccttacaaccatgctgctgattggtggtccctgggtgtcttgcttttctctctggcgactggaaaggtgagagaatagtagtagttttgggcagagaagagctttgccttgtggtgggaagaaggaagaccttaggaaatcttgccgtattcctactaaggaatgaacccctacccctacctccactccctacctcttaactcagtttccagtggctgcagagagagatcatgtggccatgttggcaagtgtgacccacagtgactctgagatcccagcttctcttaaccagggcctctcactcctgctccatgaggtaaggatgagcactgctttccttcttggctacgaaaccattaatgctctcctgccttcattaaagtgatttttccccattcctctcatcagtttttttgagggggctccaacttaactacctaactacttgccatctaagctgtactgagtcacattcctaagttcctggtcccccaaatctcctccccatctagaacagagaggtcccttctgagagagtggaacactgtacactcatctgaaaactcacaagcacagctccttattcccacctttgccccaaattagcctctatttctccctcttttacaaatcatctactcttcagggttcttattcctaccctccacagctccatgaacttctttcttcttttccatcctttctgttcaggcctgtcctgtcctagtcactcatccttcatgctctattttccttcagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacactgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattt

SEQ ID NO: 79209 - DNA, 2595 bp, Homo sapiens
cttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattatgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatgggtgagagaggttaaagctgatgggtaagcattgggcaggaggatagctaaaggatgtctgtgatgagtatctttgaaatctgtagccccagaggtcctaagtggaggaccttacaaccatgctgctgattggtggtccctgggtgtcttgcttttctctctggcgactggaaaggtgagagaatagtagtagttttgggcagagaagagctttgccttgtggtgggaagaaggaagaccttaggaaatcttgccgtattcctactaaggaatgaacccctacccctacctccactccctacctcttaactcagtttccagtggctgcagagagagatcatgtggccatgttggcaagtgtgacccacagtgactctgagatcccagcttctcttaaccagggcctctcactcctgctccatgaggtaaggatgagcactgctttccttcttggctacgaaaccattaatgctctcctgccttcattaaagtgatttttccccattcctctcatcagtttttttgagggggctccaacttaactacctaactacttgccatctaagctgtactgagtcacattcctaagttcctggtcccccaaatctcctccccatctagaacagagaggtcccttctgagagagtggaacactgtacactcatctgaaaactcacaagcacagctccttattcccacctttgccccaaattagcctctatttctccctcttttacaaatcatctactcttcagggttcttattcctaccctccacagctccatgaacttctttcttcttttccatcctttctgttcaggcctgtcctgtcctagtcactcatccttcatgctctattttccttcagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacactgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattt

SEQ ID NO: 79210 - DNA, 1645 bp, Homo sapiens
  misc_feature (58)..(58): n is a, c, g, or t
  misc_feature (81)..(81): n is a, c, g, or t
taagagagggttaaaagcttgatgggtaagcattgggcaggaggatagtaaagatgtntgtatttggggggaaaaaaaaanggggggttaaattccccttttttttgggaaaaaaattcctgtagccccagaggtcctaagtggaggaccttacaaccatgctgctgattggtggtccctgggtgtcttgcttttctctctggcgactggaaaggtgagagaatagtagtagttttgggcagagaagagctttgccttgtggtgggaagaaggaagaccttaggaaatcttgccgtattcctactaaggaatgaacccctacccctacctccactccctacctcttaactcagtttccagtggctgcagagagagatcatgtggccatgttggcaagtgtgacccacagtgactctgagatcccagcttctcttaaccagggcctctcactcctgctccatgaggtaaggatgagcactgctttccttcttggctacgaaaccattaatgctctcctgccttcattaaagtgatttttccccattcctctcatcagtttttttgagggggctccaacttaactacctaactacttgccatctaagctgtactgagtcacattcctaagttcctggtcccccaaatctcctccccatctagaacagagaggtcccttctgagagagtggaacactgtacactcatctgaaaactcacaagcacagctccttattcccacctttgccccaaattagcctctatttctccctcttttacaaatcatctactcttcagggttcttattcctaccctccacagctccatgaacttctttcttcttttccatcctttctgttcaggcctgtcctgtcctagtcactcatccttcatgctctattttccttcagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacactgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattt

SEQ ID NO: 79211 - DNA, 1467 bp, Homo sapiens
cttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattatgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgagatacaaaaattagctggtcatgagggcacacactgtggtcccagctactcgggaggctgagggggaagaattgcttgaacccgggagatggaggttgcaatgagtgaagatcgtgccactgcatccagcctgagcaacagagtgagatcttgtctcaggaaaaaaataaatttaattgctgtggatactgtaaagggtgtttatcgtaacagttcataatattctatttaagaatgcgtgggagaaattttctctggacccagttatgcttttcctgaattgctgtttggtttttaccttaaggacactaaatattcagctgattgtatttttctgtttgtactgatactagaccatttagagcccaatttgtggtctaccttcagcaagtgtttatgtattttgtatgctagtcatgttcttggttctgtcttccttttctacttttattttccttattctcatttttctaagttttaatcgttttatattactataatatctgcatcttgtaagcctttttgtaataaggttgggatataaataaataaggcaatgtatccttta

SEQ ID NO: 79212 - DNA, 1083 bp, Homo sapiens
aaaaaaaaaaaaagatttaaggttagagacatatctcaataaccttttcctttagtaaggaaaatcatctggaccttaaatttgtatacagttttggcctttatgacttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggctcacacttgtaatcccagcactttgggaggctgaggtgggcggatcaccagaggtcaggagttcgagaccagcctggccaacatggtgaaaccccgtttctccccaaaaaatacaaaaattagctggtcatgagggcacacactgtggtcccagctactcgggaggctgagggggaagaattgcttgaacccgggagatggaggttgcaatgagtgaagatcgtgccactgcatccagcctgagcaacagagtgagatcttgtctcaggaaaaaaataaatttaattgctgtggatactgtaaagggtgtttatcgtaacagttcataatattctatttaagaatgcgtgggagaaattttctctggacccagttatgcttttcctgaattgctgtttggtttttaccttaaggacactaaatattcagctgattgtatttttctgtttgtactgatactagaccatttagagcccaatttgtggtctaccttcagcaagtgtttatgtattttgtatgctagtcatgttcttggttctgtcttccttttctacttttattttccttattctcatttttctaagttttaatcgttttatattactataatatctgcatcttgtaagcctttttgtaataaggttgggatataaataaataaggcaatgtatccttta

SEQ ID NO: 79213 - DNA, 247 bp, Homo sapiens
aatggaagttaaagaataggatagggatgggatgagggctactagggaaactggaaaggacagaaaagctgcagcataccccatacttgttatccacaggttatctccatgacttgggcatcatgcatcgagatgtgaaggtagagttaagtgcttttttccctttgtctgagaaagagtctcaataagaagtgccaacaagtccaagaagttagggagctgagaactgtagacattggggccccca

SEQ ID NO: 79214 - DNA, 2846 bp, Homo sapiens
cttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattagtgagtgactggactctctcctcatcccccagggtctttgtaccatgttccccacctgagattacctctttggcttgttctgcctttgctctgtcccccttctcatggcacctctctgtcccaaagggaggggaacagcaggtggtatcagtttgggcaggaggcctacaatgccttgagcccaggcattgcagctcccaaacattgcctagacttctggcaatgtatgtagctccacactggctttgcagtgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatgggtgagagaggttaaagctgatgggtaagcattgggcaggaggatagctaaaggatgtctgtgatgagtatctttgaaatctgtagccccagaggtcctaagtggaggaccttacaaccatgctgctgattggtggtccctgggtgtcttgcttttctctctggcgactggaaaggtgagagaatagtagtagttttgggcagagaagagctttgccttgtggtgggaagaaggaagaccttaggaaatcttgccgtattcctactaaggaatgaacccctacccctacctccactccctacctcttaactcagtttccagtggctgcagagagagatcatgtggccatgttggcaagtgtgacccacagtgactctgagatcccagcttctcttaaccagggcctctcactcctgctccatgaggtaaggatgagcactgctttccttcttggctacgaaaccattaatgctctcctgccttcattaaagtgatttttccccattcctctcatcagtttttttgagggggctccaacttaactacctaactacttgccatctaagctgtactgagtcacattcctaagttcctggtcccccaaatctcctccccatctagaacagagaggtcccttctgagagagtggaacactgtacactcatctgaaaactcacaagcacagctccttattcccacctttgccccaaattagcctctatttctccctcttttacaaatcatctactcttcagggttcttattcctaccctccacagctccatgaacttctttcttcttttccatcctttctgttcaggcctgtcctgtcctagtcactcatccttcatgctctattttccttcagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacactgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattt

SEQ ID NO: 79215 - DNA, 2264 bp, Homo sapiens
cttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattagtgagtgactggactctctcctcatcccccagggtctttgtaccatgttccccacctgagattacctctttggcttgttctgcctttgctctgtcccccttctcatggcacctctctgtcccaaagggaggggaacagcaggtggtatcagtttgggcaggaggcctacaatgccttgagcccaggcattgcagctcccaaacattgcctagacttctggcaatgtatgtagctccacactggctttgcagtgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatgggtgagagaggttaaagctgatgggtaagcattgggcaggaggatagctaaaggatgtctgtgatgagtatctttgaaatctgtagccccagaggtcctaagtggaggaccttacaaccatgctgctgattggtggtccctgggtgtcttgcttttctctctggcgactggaaagtttccagtggctgcagagagagatcatgtggccatgttggcaagtgtgacccacagtgactctgagatcccagcttctcttaaccagggcctctcactcctgctccatgagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttagaccagagttccaacctggacattctgctactggcagccacagctggccctattccttccctatcatacaacctacctctcaattcaacactgtcagatcagggtggtgaccttttccttttctttacttctccagtgctctttaccctcaggctgtcagccagagctgcttctgcttgtttctctgccatgtttcctttcttgagcaataataatacttcatgggctcccagggtgctattgatgtgtttaataggcttgtcagaagcaatatgaattttttttttttttttgagacagagtctcactctgttgcccaggctggagtgcagtggtgcgttctcagctcactgcaacctccgtctcctgggttgaagtgattt

SEQ ID NO: 79216 - DNA, 1138 bp, Homo sapiens
cttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccaggttatctccatgacttgggcatcatgcatcgagatgtgaagatggagaatattcttctagatgaacgaggccatctgaaactgacagactttggtctgtcccgccacgtgccccagggagctcaagcctacactatctgtggcactcttcagtacatggctggactgtgctgctgccatctcggctcactgcaacctccctgcctgattctcctgactcagccctgtctctactaaaaatacaaaaattagccaggtgtggtgcacgtgcctgtagtcccagggaggtggaggtgggagaatcgcttgaacacgggaggcggaggttgcagtgagccgagaccacgccattgcactccagcagccagggtgacagtgagagtccgtctcaaaaaaatagcttgggcctgggaggcagaggttgaagcgagccgagattgtgccactgcactccagcctgggtgacagagtgagactgtctca

SEQ ID NO: 79217 - DNA, 289 bp, Homo sapiens
gttattgccactgaacactgaatatacatattaagcttaaaatatgtctcttaagatatgccttaagctgggcgcagtggctcacacctgtaatcccagcattttgggaggccgaggtgggcagatcacttgaggtcaggagttcaagacgagcctgatcaacttggtgaaaccctgtctctactgaaaatacaaaaattagcctggtgtggtggcaggcacctgtagtcccagctacctgggaggcagaggtttcagtgagctgagatcacgccgctgcactccagcc

SEQ ID NO: 79218 - DNA, 447 bp, Homo sapiens
ctggaggatgtaatatttctgcttttttcaatattaaaatagaaattttcttaaatagggaacttgaactgtttagatagaatttgaaaaatgttaaggttatttcttttgtgtgagctttctccttaaaaaaaaaaaaaaaaaaaaaaaaaagctgggcgtggtggctgaagcatgtcatcccagcactttgagaggccagcttgaggcctcaagaggatagcttgaggccaggtttccaagaccagccttggcaacatagcaagatcttatatctacaaaaaactttttaaaaatttagccggacatggtgctgtatacctgtagtaccagatccttaggaggctgaggtgggaggattgcttgagcctaagatttcaaggttataatgagctatgattgcaccattgcactccagcctgggaggcagagtgaaaccctgactcg

SEQ ID NO: 79219 - DNA, 471 bp, Homo sapiens
tttttgagacagtttcgctcttgttgcccaggctggagcgcagtggcgcgaatctcagctcaccgcaacctccgccctccccggttcaagcgattcctcttgtcctcagcctcccctagtagctgggattaacagcatgcgcccacccacgcccggctaatttttgtatttttagtagagatggggattctccatgttggcccaggctggtcttgaactgctgacctcaggtgatccacccgcctaggcctcccaaaatgctgggattacagtgtgagccaccgcgcctggcctgaacctgtacttttcttttaaaaagtggaatagaatagaaactttcagtgtgtttacatagtaagggtaagtattgtttcatgtgatttgtttgagttatgtgtgtatgagattatgatgtaaaatagattttgtacatctcaaagtgtaagaagcaaaatgtacttaaaaagtttg

SEQ ID NO: 79220 - DNA, 817 bp, Homo sapiens
agggaagactgttctttttcactagaagaatctcacatgctccaggtattatatgaggttctaattcctactcgtttattgtaaaaatcctggagaaagctcattgatgtaacaataaaatatgaatttttccctttaatgcagccctgtaaaacacattctcaaacctcatgtcatccaatataccttttgtattttttcttataattcatgtgtatgaatgcatagagctgctttttttaaatgaaaaaatacagaatttcacggtctttttggatttcttttaaggcctttcagtatatccaagctgaagtaacatctatgcattgttttgttattatggtaataacaagttctagtttataataatatatagtacttttttgggactaggagcaatgatatactgctttttagtaactggtaaatagtatgtttttgtctatttgaactagaaatgagaaggagaaaaaagaaactatttttaatatatataaaacatactctatttaataaagtatatgcataaaatgatacattaggtaagaagcaaaattataaagaaaacagcttataatattcctgattaattagagtttctaaatataaaaacaaatgaaagtgacttgccatttacaaaattagcacatcatacaacttttacatacttcggaggaaataaagatcttgcgacactgttctgaggaatcgttgcatttataaaaatcgaaggcttaattttgcaaatacaactttcaagccgtatgagcaaattcaacttacatgaaaggcacaagataacatcatgttgaagaac

SEQ ID NO: 79221 - DNA, 1079 bp, Homo sapiens
tgacatatcatggaaagcatttggcattaggaattaggaaatgtgggatctaaaccactcatgctattgaggtagactgattcaccagaaaaattatttcctcttctgcgctttaatattttctaacactactgttctatttttaaggacaaaaaaagtaattgttttgaaagaggtcctatgttttagctattaagtcactgataatccttttcatgagttcattttgatataaaaaccactgtgtagaatttttaatgtagattaaattagtagattcatagattacttctgatctaagaaattacttaatttccacatatagatggaaatgtatcaaatactacagtacagatagtatagtcctggatgaattcagggtccatgcagctggcttgtcaaatactcatctcacatgtctgtgacaacaaccaagttcaccttcgttacaactctcatgtccccatctgggtccctgcctgtcgccataactcttgcactattaaaatcttcaactcaacatctctgtctctgtgatctgtgatctcaactttttttctttccaactctgattcttcattctgactccctggatgtgaacacatctttgatcatataattgtttttattcccttggtccctatatttttttatgtatctcatcagctcactcttttagtttctcttcccacatagctttcctagactctattcataagtgccttactgccttatcttcctctccgagtatgctgcaaaccccagtcctgtgtcagttcagctgtttgcctttttatttcagtacccatcaaatactacctcacattcagcagatgactttccttcctaatccacagaagaaaaaggggacagaggcagaaaactgcctgaaggtttcattagatatctagaagcctatctgtatggcagcatacatttctctcagaggaaaaggtgtccttcctcttctcctaagcatacctcccctctaggccctggcttcaccctcaacagttattccttctctctgttggctctttccttttggcttaagaacatgtccaagcatcattcatcta

SEQ ID NO: 79222 - DNA, 384 bp, Homo sapiens
ctgaaaatgtggaagtgactttggaactgggtaacaggcagaggttggaacagtctggagggctcagaagaagacaggaagatgtgggaaagtttggagctttctagagacttgttgaatggttttcaccaaaaagtccaggctgaggaggtctcagatagagatgaggaacttactgggaaccagagcaaaggtgattctagctatgctttagcaaagagactggtggcattttgcccctgccctaaagatctgtggaactttggacttgagagagatgatttacgatatctggcaaaagaaatttctagatggtaaagcattcaagaagaagcagaacataaaagtttggaagatttgtgctcacttcagtggcacatatac

SEQ ID NO: 79223 - DNA, 818 bp, Homo sapiens
gatgaatttgtgtgtgttgtggctgatgtgcattttggtgctttgtatgcaagtttaagaatatcttagcaataggaaaggaagatttatggcattttaattaatgaatataatgaaggctaaaacttgtagataaatttataaggtgcttaagagctcttcaatttgttaatggaaagaaacaccatttacaccggatggctacaaagcaaccttattctgagagagaggatctcattctgtcacccaggctggagtgcatgatcatagctcactgcagcctcgacctcctgggctcaagtgatcctcctgctccagcctctcaagtagctaggactacagatcttttctcagaatagcagtctgtaggctgtcacctaaagtgtcctgttttcagtgctgcacctgctctgagcttcatctttttacgaagacgtcatggtgtgctatctgtactgggaaactttccccagcatcagccatctcctgaagataacattgtctgctagagattgtcatgtatgtggattgaatctctttatcttcatggatccagttgaaaatcaggcattgcatccagttatcatggctttaatcttaatgccttccctgcactgttttgggaatatcttaatactgctatttttgaagagtccagctcagttattctgcagaatgtctgttgatttggctttgctgtttcctcataagtagatccagattatacgtttttgttgatgttgggttcttctcagtgaatcacatccgatgatgtcagcacgaggcctgatcatttggtttaggtagctttcactaga

SEQ ID NO: 79224 - DNA, 311 bp, Homo sapiens
tattatagcacttattgtattataatttctttttacttgcctgtctactatgttagaccataagccactcaatgacagaaactatatcctattcacctttatattccaacacttatcacaatgcctattacataataggttaaataaatatttattgatatgattattctgtgtgtgactttaaaattgggggtacataatcttggtctaccatttactccagccatgaatgagccagctagctttgtgcagctgtgtctctgcagaatcttctatctctttattttttatttattattattattttttga

SEQ ID NO: 79225 - DNA, 683 bp, Homo sapiens
  misc_feature (605)..(605): n is a, c, g, or t
  misc_feature (665)..(665): n is a, c, g, or t
agcgattctctcacctaagcctcctgagtagttgggactgccgtcacatgtcaccactcccagataatttttgtattttttggtagagatgaggtttcaccatgttggccaggctggtcctgaactcctgacctcctgcctgcctcagcctcacagagtgctaagattacaggcatgagctattgcacctggcccattcttgctcttgactaaaaggtctgtattagaagagtaacaatgataacataaatgataatagcagctatcattgagtgccaggaacctgatacaggcttttttgatgtgtgcttcattctttaattcttgccacaaccctataaaatagaggttacctccattttccagaaggaggctgaagcttaaagtgagtttaagtcctgtgcctgtgagcaaaactttggcgaggaaaaattaactttgccactaagtgggggaaataaataataaacatcagagggaatggttgaatctgaaaaagtctttcttttaggaatgacttagatccacggaggatggcggtgccaaaagaagcaaagtgaagtggggaatgataagcataagaagggaaaaaaagtgaggggaanggtaccagacagacaccagacagtcgcgaagagagatgtgggaaaaaggaaatcctaccngggcttgatacagtttat

SEQ ID NO: 79226 - DNA, 238 bp, Homo sapiens
tactgcaaacaaaatttttaattttatagtgtttctaggttccatcttctctgatttaatgttagagacctcttcttttccaagcctgtgtaacataaatccactttggtcttatggccactgttgctgatgaaaatcatttaagacttctttggaccaatgagaacatttaggactacctaaagtgctggaagatcctttcaaaagaatgtgaataatgatgggaaatgaaaagctt

SEQ ID NO: 79227 - DNA, 609 bp, Homo sapiens
ctttgatctagatgcttcccagtccttgctcatctcgtaatgtcagaatgttggactgtttcatgcttctgtgccttttcccaagcagctgcctctccactggacatcctccctagacctttggaagaatggaggacctctacctgtggttcacgatcttaggtcagtgactgcttgttttgtacagctatccctggcctccccacctagaactgaccactctatctactgtgctcccagtgtacctcgtacacattctattagagctcatgctgccagagctgctacatagggttgttcaggttgtgaactgcacaactctaaggaccttgttcacgaaatgatgcatagtgaagacagtcatatatcatggccctgctttttggactgtttttcctttttttgctcttaagaatcatgggaatggggaagaaggcatgaaaaggttaagaatgtaacatgtgtcattcttatcccttgccttgtcccctccagcactttccttcctgtcctgcatactgtcgtgtggtgtgaaagcctgctgctttgggaacgatcttgtgacaatgaggggatgataaaaataaataaagatgacaagaactaaca

SEQ ID NO: 79228 - DNA, 2862 bp, Homo sapiens
  misc_feature (425)..(425): n is a, c, g, or t
aggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggatcgccacgacgggagcagcaatgggaatccgcgggtcccccacctctcctccgccgggcagcacctctacagccccgcgccacccctctcccacactggagtcgccgaatatcagccgccaccctactttcccccnccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcagaatgtcgacgaccagcacctgttgctgcacgatcagacagtcattcgcaaaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaagagccaaatcgaaaaatggaggccggtccttgcgggagaagttggacaagattgggttgaatcttccggccgggaggcggaaagccgctcatgtgactctcctgacatccttagtagaaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagcaactgtgtaaagaattcacagaacttctcagccaagaccggacaccccatgggaccagcaggctcgccccagtcttggagacgaacatacagaactgcttgtctcatttcagcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagctttttttttttgaaccccattctttccttctctgaaagtggtgctataagttttagaatcttttaaatacattccctgggccaacagacccacacacttagccattgaaatgtcaaattgatgtgccctagatcaacagatcaacaataccttttttttcagtgttaaggtaatggttggtttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaa

SEQ ID NO: 79229 - DNA, 322 bp, Homo sapiens
cggaagcttgtgcacccatgttcacagcagcattggagaaggataccgaacattcttctcgtgggcttactggccatttgtgtatctcctttggagaggagtctattcaaacctcttgcctatttttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaa

SEQ ID NO: 79230 - DNA, 3369 bp, Homo sapiens
  misc_feature (425)..(425): n is a, c, g, or t
aggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggatcgccacgacgggagcagcaatgggaatccgcgggtcccccacctctcctccgccgggcagcacctctacagccccgcgccacccctctcccacactggagtcgccgaatatcagccgccaccctactttcccccnccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcagaatgtcgacgaccagcacctgttgctgcacgatcagacagtcattcgcaaaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaagagccaaatcgaaaaatggaggccggtccttgcgggagaagttggacaagattgggttgaatcttccggccgggaggcggaaagccgctcatgtgactctcctgacatccttagtagaaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagcaactgtgtaaagaattcacagaacttctcagccaagaccggacaccccatgggaccagcaggctcgccccagtcttggagacgaacatacagaactgcttgtctcatttcagcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagctttttttttttgaaccccattctttccttctctgaaagtggtgctataagttttagaatcttttaaatacattccctgggccaacagacccacacacttagccattgaaatgtcaaattgatgtgccctagatcaacagatcaacaataccttttttttcagtgttaaggtaatggttggtttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaaaaaaagagcacagcaaccaaaagaaacaaagacacagaaaccaacagagaagggggcacacacgcacagaccgccacgacgagagacgacaacacagacacaccgacagccgaggagcgcgacagagcgagagacgcacacgaggggacggcacggcgaagagagcacaggaagacacgctcgtcagagtgggcacgggggcgaagcgaggacaccataggcgcccgcacgagggaaagcaacaggaatccgagcacatgaagacgcggaggaggcaccgcacgtaggagcggcggagaagacggacgaccgacggaccgcggccgcggcgaagaaccgcacgcgcacgccgaggatgaaccgcccgaagagagagggagataagacgcgacaacaaggggcggcgacgagcaaacgcaacaagaaagatcgggcaccagaggcgacgccgcgagagagcacagacccaggcagggagaagagagagaaggccaggcggagcgaaag

SEQ ID NO: 79231 - DNA, 898 bp, Homo sapiens
  misc_feature (4)..(4): n is a, c, g, or t
  misc_feature (48)..(48): n is a, c, g, or t
ctanctcgctcgctctgcaggccgcctctagaggatccccccttccancatctcatttctttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaa

SEQ ID NO: 79232 - DNA, 525 bp, Homo sapiens
cttcctataagtagtttcacttttctgcgaaaaccatgtttatgttttaatactcagcactactctgggtttaatgctttcaatgtcatttaaaaaacagctatctttgagacaaactcggctatgctatcactcttatgttacctgggctcacctcaagctcctgacctcaaccaatcctcacaccttggccacccaaagagctgggattataggtgtgaaccacctggtctttagaccatcattcttctagagaagatgattccttagaagtgaatatggtaaacaacccatctttccttatttgcaaagcaatattttggatattttttgagggctaagcttggtaaattgttttggacatagttttgaagatttcacaccctttttggtttcttgaaaaaccaaatgttttcttgaaaaaccaaaggaggtctttgtagcctcctttgcagtctgtcaggtattttctaggtttgtcccatgtttcaccttagcagttgaaaaacttaaaaactggttgtg

SEQ ID NO: 79233 - DNA, 316 bp, Homo sapiens
gccatgcaaatcttttaaaattcttctttaaaagtacttttcttggccttactgacatgaagcaaagaaggattctaggcccccagatggtaggatttggggtagacattctgtgtctgtctcattccccatggaattatcaaatttcccccctagccacgccagactgctaaatggtctctaagtatagcctacatttcaaggctgtttcctcagccaaaaatgccccttctccttgtctgctgtgaaactcccttccttttaccctcctctttccattatgggacagttttctcttctgggctcccttgagcac

SEQ ID NO: 79234 - DNA, 424 bp, Homo sapiens
ttacagctgactgacccaaccgggtttggggcactgcattagttacttaatccttcaaacaccccatagggcaaggactggtgatctctgacagaggaggaactagctgtgtgggtacttgagctcagagttgtctgaaccttggttaggggacctttcttcccacctttccttgtgcaggacagacgacaccctgaaaatggacaggtggggggcaccgaggggaggtctgcccagagcttggctgttctgctctgggaagcagaggtacttctgtgcccacttcttgcttgtctgcataccccagcctctcagagaggccaagagcctgtcgagggacacacagaaaagagccagcagccctagagagggcagaagcttcaaacaaggacctctcctcctaccacgcttcttcttcaaacac

SEQ ID NO: 79235 - DNA, 667 bp, Homo sapiens
cagtgacatataaatgacagaggtttccaagttcagacagttaagaaagactaccttttcatagcagacacatgaattgttaattagggaagtgcactagagcagatctcactgagtcttatacagtcaaagaaaggataggaatcctaaatccaaaacaactaaagaggcattaaattagtcaatactacgcccagcagaatgaagcaccagaataagtaacataagaacccagagagaaaaaagaaaagaaaacgagtgacaactcagggaaaggaggctgtaagagcctagaagcataggagactgtgaatgataatgccaatcctcagttttagcgtatctaatcacttctgttattcaaaaccatttttatgtttttaggcagaattagttatatgacattgcttatgttggccaattcattatttaaacgtataactaatatactcttattatcagccacctaatcatgcatattaatgataataatcatagctaacattaactgagtgataatgatatgtgaggtccttggctgggctctttatacagtctcatttggttttcataattctctcaagcctatgagatagaaactattattatccccattttaaagatgaggaaactgaggcttatagaagttaaaataacacaactatta

SEQ ID NO: 79236 - DNA, 518 bp, Homo sapiens
  misc_feature (159)..(160): n is a, c, g, or t
  misc_feature (165)..(166): n is a, c, g, or t
  misc_feature (168)..(169): n is a, c, g, or t
  misc_feature (175)..(176): n is a, c, g, or t
  misc_feature (181)..(181): n is a, c, g, or t
  misc_feature (282)..(282): n is a, c, g, or t
  misc_feature (418)..(418): n is a, c, g, or t
gctttgggaggccaagacaggaggatcgcttgaggccaggagtttgagaccagcctgggcaacatagtgagacccgtatctctaccagaaaaattatccaggtgttgtggcttatgtctattgtcctagccactctgctcactgcaacctccgcctccnnggttnnanngattcnnctgcntcagcctccagagtagctgggattacaggcaccagtcaccacgcccggctaattttttgtatttttagtagagacggtttcaccatgttggtcaggttgcnctcgaactcctgatctcaggtgatccacgcgcctcggcctcccaaagtgctgggattacaggcgtgagccaccacgcctggccgaattttcataaatgatttgaaagaaaatgagctcattctttctttttttttnagacggagtcttgctctgtcgccatcctggaatgcagccgagatcgcacctttgctctccagcctgggcaacacagtgagattctgtctcaaaaaaaaaa

SEQ ID NO: 79237 - DNA, 1252 bp, Homo sapiens
aagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccactgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcatac

SEQ ID NO: 79238 - DNA, 435 bp, Homo sapiens
tgagcctgctaattctacctttattacatagatggcatcttgagaatttaaaaataagcaagtagagttatccttgctttgcacatggcagacaaggaggactggatcttagaggctaaaaggttatgaaataaattatcaaacatgaaaatactacccaaaatgaggttgattttttgtaagagcaaagaaggactaactcaaagaaatcatttttctaggagcttcccacttacttaagcaaggaaaagataggcaaacaaaaagggatattgctgaaggaattggaacttattatttgttgttatacagtgaacgtttgtgtccccccagccccaaatcatatgtcaaaatcctaacgccctatgtgatagtattaggaggtgaggcctctgggagatgattaggtcacacaggcagagagcgctcatgaaa

SEQ ID NO: 79239 - DNA, 875 bp, Homo sapiens
tgtgggttctatccttatgatataatcacctcccaaaggccccacctcctaataccaccacattgggagttaggatttcaacatataaattttgggggtgggacacagtctatcagtccataagagcagtaatatttattagatgtctattttgtggtagccactgctaagcactttgtttcattgttaaaattcatactcaaaagagcgctatgagggaggcagtgtgattctcagtttccaactgaggacaccgaggctcagaggcagtgagtgatgtgaccgaggacacacagctcatgaaccgctaagctgagacgggtctgtcttactcccgggtgtgctcagatgaccacaatgttacaaggtctccctaaaggcgatgggcggtatacacaggaccagattgcttagtaaccactgaacatgtagagtgtgttgtttggccagaaccacagctaaaacttgcttttttgtcctgtaaatgctaattttgtggcaactgggtactcttgtggcccagccacctctaaaccaaaatcactcttagacttttggaatcagctttggagaactacttacatcactgaaacttaaaaatggggagtagtaattgtacttacacttgaagtattattcatgcagtcctcagagaatatctgaacattcttttacctctcagataatttacaaatgccttgaatgtcaacatcgaagtgtcaatgacatgaagaatttgcccatgtttatgtttttatattagtggagggagcacgcaatcccccacgaactgtaaagtcctatcatttatggaacaaacccgacaaacctgccaggtttttctggtcataacaattttgttttggcttgatcta

SEQ ID NO: 79240 - DNA, 803 bp, Homo sapiens
atcatgatctgctttacttttaaaaatctacgatgtgggcagcagatggtaccaagggcgagagtaaaagcaggtaaaccagttgggattctactgcagtggcccaggggagagagagcaaaatcatggagtcatgttgatgcaggtggggaggagtgactgggttctagatatatttgataagatttgccgaaagattgacttagggtgggacagaaggaggagtcaaagatgactgcaagcctttcagcataagaatctctaaggtcaggatgccatttgctcaggtggggaggatgaacctgagagagcaaatcaagattttgaccatgttaagtttggaacacctgttagatagccaaatgaagatgttgcagaagaagttggagtctggagttccgatgagaggtggaggctggcaatagaaattggagaggcatcaggatcaaattgccatttaaaaacagagaactagatgagatgaatcacctagggagtaagtattaatggagaatgagctctggagcacctggaacctttggaaataagaggatgaggagaatctggcaaaggaaactgagaaagagaaaccaatgacaaagggtagatgattctagggagaaaaccaatagggtccacctaggagagcaagaagagaggtgctgttgccctttcacatgcctccaagggtcaagtggtgccactggatttgaaaagtagcagaaggtcattgattactttagagagagcagcttgcaaagtcataaggtcagcagctggacaatattggatttggaagggaa

SEQ ID NO: 79241 - DNA, 543 bp, Homo sapiens
attgcttgttgatatttatgtttaatgtaattccaggtttttttttttcttcatttggtcatagaagcatacatatggtcagtttggatggtaaattttgattgtatggtagaaggcctgagctcaggcttaccttccttttttctatgaaagaaattactaagcaaaagagtagtctggataaacttggatggaagattgtaaaatatttataaaattagcaattatatgttggttaacactttatttttacctaaatgttgaagcaggttcctgataatctctgctggataacatttttggattagccattgtatctcctgaaacaaaaaagtacatgtctttttaatattttataacttgaatcaccctttcctctcgtttgttcaaataatgagattttaatgatgtgtcatagtactcaagagaattcttttttgtgcattatttatttaatggaattacctctttttaactactgcttggtcagtttacttgctaattaactaactttaatctttcaaaaagtctaattatgttaat

SEQ ID NO: 79242 - DNA, 662 bp, Homo sapiens
ggccgcctaccggctgcagaggagaagggtaggctgtgggcggcggcggggcgcggaggggtagccaggagcgcaggctgggctccgcacctccctgccccaaaacccattgatgcagcggccactgcggctgccgagcggcgtcttcccagagcccggggctgtgcccgcccgatgcaggatgcaactgaggaagcccgctccaaagcaaaacaaaacaaattcctccagccatgccgtctttctccaacccactcaagcgaaagaatggacaccagttaccagccgctgacttttgtctcagtgagaataataataggcatggtgctacctggcaccatctgaatattctccaagagtcagtaatgggactagaaaaaatgggtgacccaaagaacccttttccctacctattcccccaagccggccatttacatctcttgcgaaagaaaaagcctctgggcattggcttctccgtcaggcggtggcctcatagcgctcagtgattctcgccaggttatgaaaggccgttttagaaagctggccctcacccaccctgtgttggtgcctcagcagcagacttttttccaaggggtctcattacaagatgaagcctgacttacctctgctaacaatcaaggcatgctcgtaattaagccacg

SEQ ID NO: 79243 - DNA, 1754 bp, Homo sapiens
taatcattttaacaaatgagatagtggaagacatttatttttagcaatatggaaacattccaagaaacagaagccctctcaccatctgagagaaaatgaaaatccactatgagagaaaactgaagactttaatacagatttaagtaaaatggcctggtaatggaaaagctgactgaggaatatgttcctggctgtaacatttcttcactcaggctgtagtttctgaatttaatgaagggattattggatgacactgaagagatcgttggactagcagatcagtgtgaatgtttcctccacaactggcacgtctttcctatgacgattattgagggagatgtctctttgactgtctatggattatttggaacttttgtcaaggagccatagagttctgcagaccacacacctgtccagtgtgtctgtagccagtattttgtgattttttttcttttttgagacaagatcttgctctgtcacccaggctggagtgcagtggtgtgagcatggctcactgcagcctctgcctcctgggctcaagcgatcctcctgcctcaacctcccaaagtagctgggaccacaagcatgcaccacaacgcctggctgacttttatattttttgtagagatggagtcttgcaatgttgcctaggctggtctcaaacttctgggctcaagcgatcctcccacctgggcctcccaaagtaatgggattacaggcgggagccactgtgcccgatcttaccctgtgaatccttcaacctgcctcaacttgagccaacagagctgctggcacctcctgaaagccgactgcgtgactgctgcatggcctgacctagaggctggagggcttctctttggcatgcactgcaatgtgggtcttgagcgcccccacgtacgtgaagctccttccacactcatcacaagaaaaaggcctctccccactgtgaaggcacagatgggccttcaggcttctcttgaggcggaaacttttgttacactcgggacacgaaaagggcttctctcccgtgtgaactctgatgtgctcgtccagcttaatcttgtagatgaatttcctgccacattcaccacaagaaaacggcttttcctcgctgtgcgtcctctggtgggtcttcagggcagccttccgggagaagctccggccacactcgggacagtggaagggcctcttcccgctgtgctgggtcagatggaccttcatgcccctcttcaggcggaagcaccggtcacactgcggacactggaagggcttctctccgctgtgcagccgcaagtgctccgtgagctcgcactgctgcacgaaggcccggccgcactccccgcagcagaacggccgctccccgcggtgtagacacaggtgcttcttcaggttggccctgtaccggaaggtcttgtcgcactcagggcatgggtagggccgctggccggtgtggacaacctgatgagtgacgaggctgcccttcaggaagtagctcttctcacactcactgcactggaaccgcttcttctgacacaggagcctctgcgtccgcctgagttcggacttccctctggacgagtttttgtactttgggtatctgcagagctggctcttggagtggctccgtttgtgctttagcaaatccctccttacttggaagactttcctacagacatagcaggaatagcatcttggccctgtgggaatttctaagcgccctggggtctcccgaggcttatgccgcaggtctttct

SEQ ID NO: 79244 - DNA, 2593 bp, Homo sapiens
taatcattttaacaaatgagatagtggaagacatttatttttagcaatatggaaacattccaagaaacagaagccctctcaccatctgagagaaaatgaaaatccactatgagagaaaactgaagactttaatacagatttaagtaaaatggcctggtaatggaaaagctgactgaggaatatgttcctggctgtaacatttcttcactcaggctgtagtttctgaatttaatgaagggattattggatgacactgaagagatcgttggactagcagatcagtgtgaatgtttcctccacaactggcacgtctttcctatgacgattattgagggagatgtctctttgactgtctatggattatttggaacttttgtcaaggagccatagagttctgcagaccacacacctgtccagtgtgtctgtagccagtattttgtgattttttttcttttttgagacaagatcttgctctgtcacccaggctggagtgcagtggtgtgagcatggctcactgcagcctctgcctcctgggctcaagcgatcctcctgcctcaacctcccaaagtagctgggaccacaagcatgcaccacaacgcctggctgacttttatattttttgtagagatggagtcttgcaatgttgcctaggctggtctcaaacttctgggctcaagcgatcctcccacctgggcctcccaaagtaatgggattacaggcgggagccactgtgcccgatcttaccctgtgaatccttcaacctgcctcaacttgagccaacagagctgctggcacctcctgaaagccgactgcgtgactgctgcatggcctgacctagaggctggagggcttctctttggcatgcactgcaatgtgggtcttgagcgcccccacgtacgtgaagctccttccacactcatcacaagaaaaaggcctctccccactgtgaaggcacagatgggccttcaggcttctcttctggaggaagcctttgccacactcgggacactggaagggcctctctccactgtgcttatacaagtggaccttcaagctgcccctgatgcagtagctcttgtcacactccggacactggaagggcttctccccgctgtggactcgaatgtgttctgtgagccggtactgttgagtgaaacttttgccgcacatcacacaagagaatggcttttggccactgtgctgcagcaggtggcttttcagatttcccttgaggcggaaagtcttctcgcattcaggacactggtagggcttctctccactgtgcagcctcaggtgctcggtgagctgagactgatgcgtgtaggtcttgtcacactcaccgcacgcgaagggcttctcgtccctgtgcatccgctggtggaacttcatggaggccttccaggagaagctcttgtcgcactcgggacactggaaggctcctcgccactgtgaagcctcgtgtgctctgtgagatgcgcgcgtcggcggaaactgcggccgcactcggcgcaggagaacggcttttccgtggtgtggaccttcaggtgctgcgtgagccgcgactgctgagaaaaggtctttttgcactcgccgcagggaaactccttctgcctgtcgtggactctggtgtggcaggcgagcttggaaggccgcgtgaagcgcttgccgcactcggcgcaggggaagggcttttgctcgctgtgcaggcgctggtgggcgcgcatggcgttcctccagaagaagcccctgctgcactccgggcactggaagggccgcttcccaatgtgctgcagcccgtgggctttcaggcttctcttgaggcggaaacttttgttacactcgggacacgaaaagggcttctctcccgtgtgaactctgatgtgctcgtccagcttaatcttgtagatgaatttcctgccacattcaccacaagaaaacggcttttcctcgctgtgcgtcctctggtgggtcttcagggcagccttccgggagaagctccggccacactcgggacagtggaagggcctcttcccgctgtgctgggtcagatggaccttcatgcccctcttcaggcggaagcaccggtcacactgcggacactggaagggcttctctccgctgtgcagccgcaagtgctccgtgagctcgcactgctgcacgaaggcccggccgcactccccgcagcagaacggccgctccccgcggtgtagacacaggtgcttcttcaggttggccctgtaccggaaggtcttgtcgcactcagggcatgggtagggccgctggccggtgtggacaacctgatgagtgacgaggctgcccttcaggaagtagctcttctcacactcactgcactggaaccgcttcttctgacacaggagcctctgcgtccgcctgagttcggacttccctctggacgagtttttgtactttgggtatctgcagagctggctcttggagtggctccgtttgtgctttagcaaatccctccttacttggaagactttcctacagacatagcaggaatagcatcttggccctgtgggaatttctaagcgccctggggtctcccgaggcttatgccgcaggtctttct

SEQ ID NO: 79245 - DNA, 603 bp, Homo sapiens
gactaatctagagtgagggaaagcagacccgtgattgcgcctggggcaaggagacttgggggtggagggggggccagagggaggggtttcaaagatgataaagacattttgagggtgatggatatgatccctctcttaatagtggcgatggcttcatggatagatacaaatgtcaagacatattgaactgtatactttaaatgcttgcgctttactacgtgccaatcacatcttcataaggctgttttttgtttttttgtttgttttttttttttaaaaaaaaaggcctcgtaatggagatgagtacagcctggcctcagtctccccacctgcaatgtgggggatccccgtgtgccttgcaccacctgagagctccaggcttaggaggagaccgaggtgagccctgtttctagccagaaaccccaaggccctaacccccagggctgggcagctgcagggcccaggctactgcccctccggggatggacggtgcgaggccactccaggggcatgacctgttttgggcaggcggtggctgtggggagaagagtggggaggtccctttcttttttcttcctgaataaaaaaatgcatgatgctaca

SEQ ID NO: 79246 - DNA, 332 bp, Homo sapiens
tatgtgcagacacacagaatgacgaacttgcagtcatctgctcagctgatggctggttgagttatgtctctttacgatattcctaagtacgattagaaaggacaggaaatgactccagggctaaaaagttttattctgatttggataagtggcttgagtcaacccggatggtgatacttcacatgacaatatttgagttaaatgaaaagtctttggagaaggaatactaatgacaataggttgcgttaagtgagcctctcccaggtgccacttttcttcgaagctttgtcgcatctatcagttcatttaacaaactgagctacaaattgtgt

SEQ ID NO: 79247 - DNA, 459 bp, Homo sapiens
aaatagtttctgtttaaaactttacttgccaagctataacattctcctttgggaatttatgaagttacaaatgcaattctatgtataattgaaatttctggcaaatatgcattaaaaagaaggtctaatatttggcggtgaattttgagaggaaatgtagaatttttttaaagtatctggtgaggtagatgggattgagtaagatgagtagctctcactcagttacttatcttttacgattttcaggttaagatcttctatttctccacactgatattcaggacattcctctgggctgtcagaggttgctccctcagctcttcaggctttgacttgagtgtgatgcattcagaatttgatacctgtaacttttactgccaaggggcttgaaagaaaatcagtgtagggctcttcccagtttgagtttaggaaaggagagagttttcactaatgccaaat

SEQ ID NO: 79248 - DNA, 229 bp, Homo sapiens
gatacaaaattctgacatgtatagcgtttacattcttgaaaggggtactgtaaaccaaagtgatttcactggtgaaggaatggcataatacagagattgtgactcatgtacccatccaacttgcatataacagctacaatgcactctatgtccaaaccaaattgtgtaaattgtagttaatatgctaggataatattcctcaatttggggtattctcatgagtctgaga

SEQ ID NO: 79249 - DNA, 396 bp, Homo sapiens
ctattacacaaggatctacggctccacctgcatcacagagcttgctagaaggctcaaataattcacacaaagcacgaccaataaactggaaactgcagcagggttgtaggccttattatctctcctcagtgaaatgcttggattttaaactcttcctttcaaacactattctaaagagtaataaaattcccataaggctaacagtctccataattcaatagtctatctggctggtcaatcagaaatatgttacaggttccaataacaaacatcagtaatagtgccattgttctaacggtttctgcaatgccatagtactaaggctatgcaaagcttgtgtttcttcgagtggtgttgaataagcaacatcttatccactgacatccgcatgaaatg

SEQ ID NO: 79250 - DNA, 208 bp, Homo sapiens
ggcagctttaatgcggaacgccggtgcagcagcacggagcacactcccagactacagtggcgcccgcactcacgcccttcaagtgccccacccctcccacacagtggccaaggagccaagccctatccctaagagttgcgtgcagccgcaccacccctggtctccactttctgggcgcaccaactcccccccttgctcgagtcccccg

SEQ ID NO: 79251 - DNA, 753 bp, Homo sapiens
tccctggcttcctgagggcggaagctgtgtgcggcctggtaagggtggtgcccactgggagttcttgaagctggcattaggctccaggtgggcagcctcacagccttgtctctcagggccaggccatggagagactctggacgggctaatgtggtggagaggatgtagcttgtcatatgggtgtgacacattggggtggtatcaccccacttcctggctgtgcaagggttggagttcatgcagacagatctatcttgcaactaccaggatagaaactcaggagtccccagtgaattagtgaaagaaatgtctatttattgagcaccagttaatcagatatttaagttattgcatttaattctatttctctattttggagaatcttgaactgggtccgtgaattagatggtattaatgtatacaatgttaatttcctgatctcagtgggtatgttagggttatgtagggaaaagtccttgtttatgggaaatagacaaagtagcgggggttattgggcataatgccagcagtttactttcaaatggggaggggacatgttctttctactcttcttgcaactgttctgtaaatttgtaattattttaaaagaaacactttatttgaaaaattactagtctcataaaatgagccacacaactctatttttttgtgttctgcagcaattaaatgacattatataacaaggacagaaagtaactgtcctttgaaaaattagaaactcaactatattaa

SEQ ID NO: 79252 - DNA, 425 bp, Homo sapiens
ggtaaaatggattaaaagaaaaaagaatgccatgaggctacccaaactgttagtagaatcttaggttttatatacagaactatagcatctggcaaatgggagttgatagaactgcagtattcacggattgagcagtgtgttgagtccttaagcaccgcatttgaaaagatggctgcgactgtactggatggtgatgaggcgtatgagcaatggaaccagggacatttgggttagaaaacagaaactcagggaaggcgtcagtgcagtttttagttatctcaaggtttcatcccgtggaagaaagaaaacttggtgctttgttatgttcagttcctggggatatatgttatggaacaggggaatggatttcagatcaatgcaagggaagacctatcagtctcccctgctcaaggcccaggagacat

SEQ ID NO: 79253 - DNA, 542 bp, Homo sapiens
acagtggtgagctcttagcttcaccaggctcatcaaagctgctccaggaaggcccaagccagaccagaagacatgcagatcatcaccacagccctggtgtgcttgctgctagctgggatgtggccggaagatgtggacagcaagagcatgcaggtacccttctccagatgttgcttctcatttgcggagcaagagattcccctgagggcaatcctgtgttacagaaataccagctccatctgctccaatgagggcttaatattcaagctgaagagaggcaaagaggcctgcgccttggacacagttggatgggttcagaggcacagaaaaatgctgaggcactgcccgtcaaaaagaaaatgagcagatttctttccattgtgggctctggaaaccacatggcttcacctgtccccgaaactaccagccctacaccattccttctgccctgcttttgctaggtcacagaggatctgcttggtcttgataagctatgttgttgcactttaaacatttaaattatacaatcatcaacccccaac

SEQ ID NO: 79254 - DNA, 294 bp, Homo sapiens
tccggattggcaagatccccctgctttagaaacccttgcttataagcatggggaggtcaggtcttaggcgtgagctgccaattctccttgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtc

SEQ ID NO: 79255 - DNA, 522 bp, Homo sapiens
ctaacaggtatcatcagtttctcatgaaaatcctactgaagtgtttgaagatggagaaaatccaccaagtagtcgatcatcagagagtggattcactgagtttatacaatatcaagcagaccgaactgatgatattgacagagaactgagtgagggccagggggcagctgccatcccaattggtagcacatcctctgagacagaaacagcatccactgtgggatctgaagaaaccatcatccagaccccttccgtagtcactcaggggacagcaacccgaagtaggaagacagcccaaaagactgcaatgcagtgctgcttggagtatgtccaacagtttcttaccagacttatcaacctctacatcattcagaataactctttttctcagtctttggctacagaacatcaaggggatcttggtcgagaacaaggagagacttcaaaatgggacagaaattcacaaggagatgtaaaagagaaaaacataagtaaacaaaaaacttctaaagaatacctgtc

SEQ ID NO: 79256 - DNA, 315 bp, Homo sapiens
gaaaagataaacaaaattaatagaccattagtgagattaaccaagacaacaggaaagaagatcttaataagctcaattagcaatgaaatgggagctactacaactgataccacagaaatacaaaagatcattcaaggctactatgaacaccttcacgtgcacaaactagaaaacatagaggagatggataaattcctggaattttaagaataatacaatggactttggggaatcaggagaaagggtaagagtggggtgagggataaaagactacacattgcatacagtgtacacttcttgggtgatgggtgcgcc

SEQ ID NO: 79257 - DNA, 451 bp, Homo sapiens
ttgttaacttatacagtatgactgtaggtctttcaatttagttgttgtactatattctccttttattataaaatcataaaataattgaatttctgtgctgaaaaggacctcacacattatccagtctaaccccttcactcattaagttcatgaacatagagattgagatttgaatttggccaagtaatagagttagggatagacccaggatactctgactgctagtttgtgcttattctgattctggtgtattacttcactaggcctagaactggtaataagagaacctctattctagttccactctttaaggacatggagcagtgtcatagatgtagtttgtgctcattaattatttgttctaatgaacaaatgaatgagctcttttaaatgatgtgattattggcaatacctgatttatgagtagggcctcttcgtaagaattttcctt

SEQ ID NO: 79258 - DNA, 203 bp, Homo sapiens
tcctgcaaagatgtcctgccagcaaaaccagcagcagtgccagccccctcccagttgtccctcacccaagtgtcccccaaagagcccagcacagtgtctgcctccaccctcttctgactgtgctctaagctccgggggctgtggccccagttctgaaagtggctgctgcctgagccaccacaggcacttcaggtcccatcaat

SEQ ID NO: 79259 - DNA, 478 bp, Homo sapiens
gcaaaagttaaagaagatcactttcaaagaaactcaaataaatacaagtcaaagcctttcctgaatttgaatttgttcattcatgcttacataagggaatgtgctaaccatgaatcattcaaattgaactgctcatgagaaaaagtgtgctggctttactgtcagtttccagagttgcttgactgaaaggaaaagagcattgtctccacataaagaataatcagccacagattttaggcaaagcagggatccaaattggcaaaagttctttcaattcacctgagaacgtggatgcttgtgagaaggtcttgctatctgaatattctgtactgtgactgagtttgcaggctgcaagaacagcccacggaaaagtttaaaaaaatcaatcatttggaaatgttgttcacacaatgccagaatagctaaatgctccaccaatgtggatgctgacatatctgtagctagaggcaattggatg

SEQ ID NO: 79260 - DNA, 349 bp, Homo sapiens
gaaagaaagaaagaaacttcaatattatcagtagagtccaatgttgtgaaacccctcattaactaaatttccatactcttcagtaggtagaaaataattactttttgattcattagaaagcacttaatttttaagatggagatcatgtaattttgaactctaggtcttgcctactcctatataaattctcctctaaacaacagccaaaattgaggccctctttgagcttcaggctggtgccaaatggctctgcttattttccccaaaataaatcttccttccatgtatgatgagaccccctccagtataaagaagacccaaagaaaatcacccaaagaaaaaaggccca

SEQ ID NO: 79261 - DNA, 5276 bp, Homo sapiens
caagagcggaggaccaggaaccagagagagagagagagaaaagagagaggagagacagagcgcttgggggcgaaaggagagagggagggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctggggctactacggctgcgacgaggagctggtgggtcccctgtatgcacgctccctgggcgcctcctcctactacagtctccttactgcgccgcgattcgccaggctgcacggcataagcgggtggtcaccacggattggggatccgaatccctggctccagatagacttaatgaagaagcaccggatccgggccgtggccacacagggctcctttaattcttgggactgggtcacacgttacatgctactctacggcgaccgagtggacagctggacaccgttctaccagcgagggcacaactcgaccttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacaaggccgacatactctatttcgacggcgacgatgccatctcctaccgcttcccgcgaggggtcagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgagatgttcatcggaggtctggtgggcgccgcgcggaagaacctggcctatcggcataacttccgcggctgcatagaaaacgtaatcttcaaccgcgtcaacatcgcagacctggccgtgcggcgccattcccggatcaccttcgagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctgggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtgcagccctaacatgtgtgagcatgatggacgctgctaccagtcttgggatgacttcatttgctactgcgaactgacgggctacaagggagagacctgccacacacctttgtataaggaatcctgtgaggcttatcggctcagtgggaaaacttctggaaacttcaccattgatcctgatggcagtggccccctgaagccatttgtagtgtactgtgatatccgagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatggagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccagacttcccctactaccatgatgaaggatgggttgccatacttttaggctttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggc

SEQ ID NO: 79262 - DNA, 4531 bp, Homo sapiens
gtgcatgagccacgcaggcccctagttaagaagcagtggtcgggtccaatcaccttcttagttcatagatgaagaaagtaaggcgcagacacagggagtggcttgtccaggggtcgtgcagctgcacggtggctgagtagggacttgaaccgatggcttctctgatatgcccccctcaaccctctccgactctggagctctgttgggaagctggcaggagccaggtctgtggtccaaaattgcctctcgatactggaaggagagaagcggtcgaatcgcagacggtggagatcagcgagagcaagcgagcagagttccgagggccgactgggttggggccccctccacagatggacgagcttggaggggaagaggtcacgtcatggttggagatctcacccccgccaacaccgaaggagggcggtgaccagggtcttagaccggtgtgaaaactgaattcccagctgaggcagaggcggctcacgggtgttgatgcgtcttcacttttgcccctagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctgggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtgcagccctaacatgtgtgagcatgatggacgctgctaccagtcttgggatgacttcatttgctactgcgaactgacgggctacaagggagagacctgccacacacctttgtataaggaatcctgtgaggcttatcggctcagtgggaaaacttctggaaacttcaccattgatcctgatggcagtggccccctgaagccatttgtagtgtactgtgatatccgagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatggagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccagacttcccctactaccatgatgaaggatgggttgccatacttttaggctttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggc

SEQ ID NO: 79263 - DNA, 3248 bp, Homo sapiens
  misc_feature (3)..(4): n is a, c, g, or t
  misc_feature (39)..(39): n is a, c, g, or t
aanncccaactccagccaaagctctgtcccctcttgtcngccagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatggagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccagacttcccctactaccatgatgaaggatgggttgccatacttttaggctttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggc

SEQ ID NO: 79264 - DNA, 4704 bp, Homo sapiens
gtgcatgagccacgcaggcccctagttaagaagcagtggtcgggtccaatcaccttcttagttcatagatgaagaaagtaaggcgcagacacagggagtggcttgtccaggggtcgtgcagctgcacggtggctgagtagggacttgaaccgatggcttctctgatatgcccccctcaaccctctccgactctggagctctgttgggaagctggcaggagccaggtctgtggtccaaaattgcctctcgatactggaaggagagaagcggtcgaatcgcagacggtggagatcagcgagagcaagcgagcagagttccgagggccgactgggttggggccccctccacagatggacgagcttggaggggaagaggtcacgtcatggttggagatctcacccccgccaacaccgaaggagggcggtgaccagggtcttagaccggtgtgaaaactgaattcccagctgaggcagaggcggctcacgggtgttgatgcgtcttcacttttgcccctagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctgggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtgcagccctaacatgtgtgagcatgatggacgctgctaccagtcttgggatgacttcatttgctactgcgaactgacgggctacaagggagagacctgccacacacctttgtataaggaatcctgtgaggcttatcggctcagtgggaaaacttctggaaacttcaccattgatcctgatggcagtggccccctgaagccatttgtagtgtactgtgatatccgagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatggagacaggagtcattgacccggagatccagcgctacaacaccccaggtttctcaggctgcctgtctggtgttcgattcaacaacgtggctcccctcaagacccacttccgaacccctcgacccatgactgctgagctagctgaggcccttcgagttcagggagaactgtccgaatctaattgcggagctatgccacgtcttgtttcagaggtgccacctgagcttgatccctggtatctgcccccagacttcccctactaccatgatgaaggatgggttgccatacttttaggctttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggctgtgctgtcctgtgctgtgctgtgcccacagtctgtagtttgcctttcctgtgttggaagtgtcgtgagtcctgctggtcacccaccagcctggtccggcctccactctgaagcagggttgagcctgctgtgctctcagacgcggagccgttccaataaagcagagtggcaga

SEQ ID NO: 79265 - DNA, 4321 bp, Homo sapiens
gtgcatgagccacgcaggcccctagttaagaagcagtggtcgggtccaatcaccttcttagttcatagatgaagaaagtaaggcgcagacacagggagtggcttgtccaggggtcgtgcagctgcacggtggctgagtagggacttgaaccgatggcttctctgatatgcccccctcaaccctctccgactctggagctctgttgggaagctggcaggagccaggtctgtggtccaaaattgcctctcgatactggaaggagagaagcggtcgaatcgcagacggtggagatcagcgagagcaagcgagcagagttccgagggccgactgggttggggccccctccacagatggacgagcttggaggggaagaggtcacgtcatggttggagatctcacccccgccaacaccgaaggagggcggtgaccagggtcttagaccggtgtgaaaactgaattcccagctgaggcagaggcggctcacgggtgttgatgcgtcttcacttttgcccctagggtaaggtggcttttcgttgcctggacccggtaccgcaccctatcaacttcggaggccctcacaacttcgttcaagtgcccggtttcccacgccgtggccgcctggcagtctcatttcgcttccgcacctgggacctcaccgggcttctccttttctcccgtctgggggacgggctgggccacgtggagctgacgctcagcgaagggcaggtcaacgtgtccatcgcgcagagcggccgaaagaagcttcagttcgctgctgggtaccgactgaatgacggcttttggcacgaggtgaattttgtggcacaggaaaaccatgcagttatcagcattgatgatgtggaaggggcagaggtcagggtctcatacccgttgctgatccggacagggacctcatatttctttgggggttgtcccaagccagccagtcgatgggactgccactccaaccagacggcattccatggctgcatggagctgctcaaggtggatggtcaactggtcaacctgactctggtggagggccggcggcttggattctatgctgaggtcctctttgatacatgtggcatcactgataggtgcagccctaacatgtgtgagcatgatggacgctgctaccagtcttgggatgacttcatttgctactgcgaactgacgggctacaagggagagacctgccacacacctttgtataaggaatcctgtgaggcttatcggctcagtgggaaaacttctggaaacttcaccattgatcctgatggcagtggccccctgaagccatttgtagtgtactgtgatatccgagagaaccgagcgtggacagttgtgcggcatgacaggctgtggacaactcgagtgacaggttccagcatggagcggccattcctgggggctatccagtactggaatgcatcctgggaggaagtcagtgcccttgccaatgcttcccagcattgtgaacagtggatcgagttctcctgctacaattcccggctgctcaacactgcaggaggctacccctacagcttttggattggccgaaatgaggagcagcacttctactggggaggctcccagcctgggatccagcgctgtgcctgtggtctggaccggagctgtgtggaccctgccttgtactgcaactgtgacgctgaccagccccagtggagaactgacaagggactgctgacctttgtggaccatctgcctgtcactcaggtagtgataggggatacgaaccgctccacttctgaggcccagttcttcctgaggcctctgcgctgctatggcgatcgaaattcctggaacaccatttccttccacaccggggctgcactacgcttccccccaatccgtgccaaccacagcctggatgtctccttctacttcaggacctctgctccctcgggggtcttcctagagaatatggggggcccttactgccagtggcgccgaccttatgtgcgggtggaactcaacacatcccgggatgtggtcttcgcctttgatgtggggaatggggatgagaacctcacagtacactcagacgactttgagttcaatgatgacgagtggcacctggtccgggctgaaatcaacgtgaagcaggcccggctccgagtggatcaccggccctgggttctgcggcctatgccactgcagacctacatctggatggagtatgaccagcccctctatgtgggatctgcagagcttaagagacgcccctttgtgggttgcttgagggccatgcgtctgaacggagtgactctgaacctggagggccgtgccaatgcctctgagggtacctcacccaactgcacaggccactgtgcccaccctcggctcccctgtttccatggaggccgctgcgtggagcgctatagctactacacgtgtgactgtgacctcacggcttttgatgggccatactgcaaccacgatattggtggtttctttgagccgggcacctggatgcgctataacctacagtcagcgctgcgctctgcagccagggagttctcccacatgctgagccggccagtgccaggctatgagcctggctacatcccgggctatgatactccgggctatgtgcctggctaccatggccccgggtaccgcctgcccgactacccccggcctggtcggcctgtgcccggttaccgtgggcctgtctacaacgttacgggagaggaggtctccttcagcttcagcaccagctccgcccctgctgtcctgctctacgtcagttcctttgttcgtgactacatggctgtgctcatcaaggatgatgggacccttcagctgcgatatcagctgggcaccagtccctacgtgtaccagctaaccactcgaccagtgaccgatggccagccccatagcatcaatatcacccgtgtttaccggaacctcttcatccaggtggactacttcccactgacagagcagaagttctcgctgttggtggacagccagttggactcacccaaggccttgtatttagggcgtgtgatgggtaagctgcgggtgcggacgcgttttaggcaaggagctgtggcatatgttcctggatctgaattgcccctttttttcttttcagttttggtggcctttctgctgctggggctggtgggaatgttggtgctcttctatctgcaaaatcatcgctataagggctcctaccataccaatgagcccaaggctgcccacgagtaccatcctggcagcaaacctcccctacccacttcaggccctgcccaggtccccacccctacagcagctcccaaccaagctccagcctcagccccagccccagccccaactccagccccagcccctggcccccgggatcagaacctaccccagatcctggaggagtccaggtctgaatgagtcagaagggcttctgggaccaattccagctcctgacattcccccagtcctgcctctcccccatcctatcagggacatttggctcctcttagctggctctgctcatccagaggatattcccccatcccccccccatcaagtttggtgggcagagctacagatgggacccaagggagtggccgagcctcactgcctaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggc

SEQ ID NO: 79266 - DNA, 1069 bp, Homo sapiens
agcggataagtgtatactggtgaccgatactaggattaaggttttgccaggcttaaggctggactttggagctggccaaggggtggggtttgtggctagggctggggtttgtggctggggctgggttttgtggcagggatccaagcaggagctggtgcccctgactgatgctaaggctggacatggagctggtgatggtgctagcactggctgaggttgggtgcaaggcctgtatttggggatggtgcaggttttgggggccgagttggatttaggctagggttggagctggattggtgtcttgggttgacttaggttgtggaagatgctgaggtttaggattgagtttgggaaagtactaaaccaatgcccttctcatccctgtttccccaggctcctggctgtttatctgccccaaaggagaagcctcatggggttgacataggtcctttctgccatctctgttccagctgctgtcagggattaacaacagagtgtaggggagattaactgcctcccttccaatagacactatcagcagggacagatgtgtgggagtgcagggctgcagagggtatggggggaggaggctgctaaaccctatcccccagcctcccccctgccctgaagatcttccatttgcttccactcagctggaggctcaagagggcttgatggctgtcccctgcccccctccttttgttttgtacacagagaccaagaggcctcagtttagcaccttagtacctccgctgcttcacttgctttagccaaagccataaaaaacctgcaacgtagagaaaataatgcagataccctgactagccagccctctactcctccaaccttttccaagatatgcaatggcctttgtgcctgcccaaaggcttcgccccctccagtgcatgaggaaccctctttcctccgctcagagatgctgcttcatttacccaggaggtcatattctttatatatattttttgttgcaaagtgtctctctagagaaactctatatattattcgaatttttaaattatttgtttatatataaaagaaaagctcaattggc

SEQ ID NO: 79267 - DNA, 472 bp, Homo sapiens
tgccacctgagcttgatccctggtatctgcccccaggtacattcccaggacacagaggacagaagggagggatgacacggaagggaatgattcttaacatggaggaggcatctcctaactggtgctttctcctctccagacttcccctactaccatgatgaaggatgggttgccatacttttaggctgtgagtagcactgatcactaagctgacctcccaagactaccctctgactgtcagcatcctttccctgcccctgatccccaaggctgcaggatggcaaaggcactagatgcacaatggcacaaaggatgatgagacaggctatgctgaaggtgccatataactgggcagagatttttagatgtttgaggatgagacaggctatgctgaaggtgacatataactgggcagagatttttagatgtttgaggatgctacagatttttaaataaaatattaaaatgagac

SEQ ID NO: 79268 - DNA, 3706 bp, Homo sapiens
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaaaaaaaaaaaaaaaaaaaaaaaaaaaaaaaaaaaaaaaaaaaaaggggggggcggcaaaaaatccccccggggggccccatttcctcccccaggtttttttttgatcaaaagcggggcccctatatagatgagagcctccgtatttataacagcacaaaggcaacacgaggcgcggctgttataaacaacccggtcgtcatgcggcggaaacactgctgcagagcgtggaacacttgtgggagaaaagaaccccatcaactctcgggggggcggcagcaacattatggtgggaccaaactccacccttacgaagaataattttaacgagctcagagggaacaactattgtaacacttcaagcgtgtatccatcggtttggttaccacaacaacggagataaatttacctagcgctttaaagaattctggcactacaggaaatatatttttcgcaaacattttttcaa

SEQ ID NO: 79269 - DNA, 370 bp, Homo sapiens
gagggagggagagagagggagatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaattaattgtaagtactaatgtagatactaatttttttttaa

SEQ ID NO: 79270 - DNA, 3426 bp, Homo sapiens
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79271 - DNA, 3356 bp, Homo sapiens
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacaagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79272 - DNA, 3309 bp, Homo sapiens
tagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaaggggaaaacccttggatgcttcatagtcctacttctaggcagttctgcatgaatttctggtaatccaggtaaacaggatattgccgtagaagaggttgatggtagcttgaaccagggtggacacaaaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79273 - DNA, 3321 bp, Homo sapiens
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79274 - DNA, 3242 bp, Homo sapiens
  misc_feature (3098)..(3098): n is a, c, g, or t
  misc_feature (3137)..(3137): n is a, c, g, or t
  misc_feature (3168)..(3168): n is a, c, g, or t
  misc_feature (3206)..(3206): n is a, c, g, or t
  misc_feature (3225)..(3225): n is a, c, g, or t
  misc_feature (3233)..(3233): n is a, c, g, or t
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaagggagntccccagcttgcaaaaccctgtaaatatcagtgtttggnccgtaattgcccactttttcctaattccttnacttcaggccccttttccctccctttaggggcattggncctctgttggccctttttntcaccagntggtttccc

SEQ ID NO: 79275 - DNA, 3220 bp, Homo sapiens
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaattcacatttattatgcagatatgccaggcagaagaaagagaaaagaatgggttctgtaagaacgattcggtaatgcaccaaaacagagattggagtggttccttcaatcaattgtatggaagagtaataaggagattgactgcttgtcaaagagtgcttaagaattttcaaaggggggaaattattgacgaagaggagggttctttgtttataagggaaagtttggtcgagtaaaagttaagatggatgtggcaaaggttgctaattttgcttaaaaaaggg

SEQ ID NO: 79276 - DNA, 1499 bp, Homo sapiens
cgacccacgcgtcgcccacgcgtcgacccacgcgtcggtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79277 - DNA, 917 bp, Homo sapiens
agatcatgtcatgcactcaagcctggccaacagagcaagactctgtctctaaataaataaatatttctgtgaaggacattattggtattttgatggggattacactgaatttgcaggtcactttggatagtaaatagttttaatttttttagttaaaaaaaaatacccataaaaatacttggtgtatatatagtaagcacttaataagtatttgacgaagcaatatttttctaacatactgaataaacatttcaaataaaaatgaatgaatgttttggggattatttctcctctgaactctaagctttgttaatttaattcatttttcccccagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79278 - DNA, 709 bp, Homo sapiens
  misc_feature (4)..(5): n is a, c, g, or t
agcnngcgtgacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccagcttaaaccaggaccgatcttaggtgcacacaaggctaggaggatttttcacaccaaaattcacacacctaggggacacaccagagtgccttctatagaacccttaaagtgttagaggagcgcgttagagcaccagctcttatgatctctgctgcactagtctctagagcatcatgtgcgaaaacagcacgagtagtttgattatctccagcagcagtctcatactcattacagcagct

SEQ ID NO: 79279 - DNA, 649 bp, Homo sapiens
tagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaaggggaaaacccttggatgcttcatagtcctacttctaggcagttctgcatgaatttctggtaatccaggtaaacaggatattgccgtagaagaggttgatggtagcttgaaccagggtggacacaaaggtgagaagcaactggattgtttgggcaggtgtgtgtgtgtgtgtgtgtgtgtgtgtgtgtgtgtgtttaagagacaggttctggctgtcattcagcctatactgcagtttctcaaatctcaagtgagcctcccgcgggcctcccacagcgttgaggttacagatatgagccaccctatctggcctcaggttgtatttttaactgcaaatggttttgcctaattcgtagggttgagaaagaaaaaagcaagtttaggaagatcacacttgtggagctcaattgtcttgtttaatcaggaggccaggttgtccacctagagtgaaaatagcttcagaggcttgaggactgaaaatagtaaaggtctggaagacagcagag

SEQ ID NO: 79280 - DNA, 203 bp, Homo sapiens
aggtagataagaccttactattaattctgtattaaagaattgttatcactctttatttagattttcagattctacttcaaagactcctcctcaagaagaattacctactcgagtgtcatctcctgtatttggagctacctctagtatcaaaagtggtttagatttgaatacaagtttgtccccttctcttttacagcctggga

SEQ ID NO: 79281 - DNA, 3280 bp, Homo sapiens
  misc_feature (4)..(5): n is a, c, g, or t
agcnngcgtgacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79282 - DNA, 331 bp, Homo sapiens
ccggcactgttgttcataccaacgaacgagactctggcatgctaactagttacgcgacccccgatacagcgaccaggtatgaacaacagtgcacagctgagcttgaatgtgaggaagacgttattccagattcaccgataacagccttctcattttctggcgttaaccggctacgaagaaaggagaacccccgatacagcgaccaggtatgaacaacagtgcaggtatgaacaacagtgcaggtatgaacaacagtgcaggtatgaacaacagtgcaggtatgaacaacagtgcaggtatgaacaacagtgcaggtatgaacaacagtgca

SEQ ID NO: 79283 - DNA, 3229 bp, Homo sapiens
  misc_feature (4)..(5): n is a, c, g, or t
agcnngcgtgacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccactacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79284 - DNA, 3069 bp, Homo sapiens
agcggtttgagaacatgcgggctacagagaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79285 - DNA, 2847 bp, Homo sapiens
ttagggctatcgttaccggcgtcggataaagtaagcgagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79286 - DNA, 2995 bp, Homo sapiens
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaattctgttaacctatgtgatatatcatcagccccatgaatccgccatacatggtcata

SEQ ID NO: 79287 - DNA, 1274 bp, Homo sapiens
gcctactactactaaattcgcggccgcgtcgacgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaa

SEQ ID NO: 79288 - DNA, 2918 bp, Homo sapiens
cgcaccgataccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccagcactctttatgtcatctaaaacattctcagtctccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaattctgttaacctatgtgatatatcatcagccccatgaatccgccatacatggtcata

SEQ ID NO: 79289 - DNA, 489 bp, Homo sapiens
  misc_feature (189)..(189): n is a, c, g, or t
gctgggtgcagatgcagtgtggctctggatagcaccttatggacagttgtgtccccaaggaaggatgagaatagctactgaagtcctaaagagcaagcctaactcaagccattgcacacaggcattagacagaaagctggaagttgaaatggtggagtccaacttgcctggaccagcttaatggttctnctcctggtaacgtttttatccatggatgacttgcttgggtatggagagtcggcttgactacactgtgtggaacaagttttaaagaagcaaaggactcagaattcatgattgaagaaatgcaggcagacctgttatcctaaactagggtttttaatgaccacaacaagcaagcatgcagtttaccacttgaaagggtcttgcctcacctaagctggagtgcagtggccctttgaggcttactgtagcctcgaactcctgggctcaagtgatccttagcctcccaatggtctttgtagacag

SEQ ID NO: 79290 - DNA, 700 bp, Homo sapiens
ttctgtacttatcaagctgaacatatccttaatcagaccacagtgcttggagcacaatgggcccttaaaaatggggacaagagggaagaagaaaggaaggctggggcaagcaaaaaggagagccagatttctttgtcaagttttaaaagtatcgctgtacggaaattttacagaagaaattttgaacaccacagatttttgccttttgagttattatttgcattaacgtaatattaacagggcaacaatgtttttcgatttatcatgtggttaagcaaattgttaaacacatttgattaccgaaaacagggaatatggtagaagatcaaagacatgccagaaatttttattttatgtgggacactcggaatttagttgagcctgacagagtcctgctggctaacaccaaggagagactattgctggccccatgcaagtggctggaataatggaagtcaagaaggaaatctccacatggtcgacactttgaagttggtcatagataggaagttagaacaaactccagtgggtgaggggtcatgagtttaccaggagaaggtaacttaagactgaatgaacaaaaagaatttgtggtcacacgaaaataaggagcaaaacttcaggaacagtctgagataacaagaagctttatttccaatatatgggtcccatcccattgtaacactaattgagaacttcc

SEQ ID NO: 79291 - DNA, 2250 bp, Homo sapiens
gtctacttatcaataagcagctgcctgtgcagagtgcaggctgcacctttggacagcctttaaaactgaattctcagaattttagaacaaatttttgtctagaaatgctgactttggttcattaggtagtggtaaaacaggctcccttcgaagctctccttcatcaccttcctaagtgcatgtacagggaagctctccttcatcaccttcctaagtgcatgggggaaaatacctagggctcaacagtcttgagaagtgtggaaacattttctttgtgagtgagaacagatcacctagagaaaggaaaccagattcccatcactgcttctgggtatcagatgctagcgctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggcctttctttgataagacaatatgtacatagttttttcaaatattaaagatcttttaactgttggcagttgttatctacagaatcatatctcatatgctgtgtagtttataagttttttctctatttatcagaataaagaaatacaacatacctgtaaa

SEQ ID NO: 79292 - DNA, 1957 bp, Homo sapiens
ggcaggaggaactgaagcccagctgtgaaggccgcagactgcagtgagaggaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggcctttctttgataagacaatatgtacatagttttttcaaatattaaagatcttttaactgttggcagttgttatctacagaatcatatctcatatgctgtgtagtttataagttttttctctatttatcagaataaagaaatacaacatacctgtaaa

SEQ ID NO: 79293 - DNA, 366 bp, Homo sapiens
actaacttctgtagaaaaaaatggtttccaaagcaccattcttgaaaacacatgcaaggctatatttaccacagaaaaggtctgctttcctctttaggaaacataacttcatttaaaaacataatctttcaatcatgccatacatggatttatttgagcataaacttttttatttatcttcccataaaatcttagattttccctaaactagttaatgcatctttaactttcgacttggacattccaaagagaccacgcatctgtattccatatccttgaaatccacagactgcacagagggcctacctcctctcacaagaagtaagcacaatggttaggcaatcagagatacgtgccttgaagcag

SEQ ID NO: 79294 - DNA, 431 bp, Homo sapiens
ggctgtgatgctcacttgccagtcactcatctcctgctgtgcagcccggttcttaacaggccatgaactggtgctggtctgcagcccagggtttggggacccctgtctcattgaatatatgaaattgggaagaaagtcaggagttcctaaaaggacaagagaggaaaaaaattcagataaggactgaaaaaaaggttatttatttcagaagagacagatgagagggtaaaggtctgagttataaggcctttgtaaggagatcctcttcttcagccaggcaggaagatacatacagatgggtgccctcacagtttagaggtcaaaaggaggaatacggccgggcacagtggctcatgtgtgtaatcctggcaccttgggaggctcagatgggaagatccctcaagcccaggagaccagcctgggcaacatag

SEQ ID NO: 79295 - DNA, 417 bp, Homo sapiens
ggctgtgatgctcacttgccagtcactcatctcctgctgtgcagcccggttcttaacaggccatgaactggtgctggtctgcagcccagggtttggggacccctgtctcattgaatatatgaaattgggaagaaagtcaggagttcctaaaaggacaagagaggaaaaaaattcagataaggactgaaaaaaaggttattgtatttggcaattaggcattttgagaatagatgtagtaaagtcataaggataaaagcttaatttcagtgggttgacaaattaagagagctgaagaaggtatagaaaataaaacttctggccgggtgcggtagctcacacctgtaatcccagcactttgggaggccgaggcaggcagatcatgaggtcaggagatccagaccatcctggctaacacgg

SEQ ID NO: 79296 - DNA, 485 bp, Homo sapiens
ataagtgagaatatgcggcatttggttttctgttcctgcgttaatttgcttaggattgtggcctccggctccatccacgttgctgcaaagactatgatctcaattttttttatagttgcgtagtattctttagtgtatacatactgcattttctttatccagtccacttttggtggccacctgggttgattccacgtctttgctattgtgaatagtgctgcagtgaacataggtgtgcatgtgtcttcagggtagaacgacttatatttctgtgggtaaatggaattgctgggtcaaacggtaattctattttaaattctttgagaagtctccaaacagaacaggacttttctgagtagagtgttaaatatgtggacaaaaactgatggaactgcaagaatcaatagacaatgcatatttatagttagagatttcaatacctttctcaataactgaaaaaacagaaaatctgtgagaatatatac

SEQ ID NO: 79297 - DNA, 231 bp, Homo sapiens
aaggacatgaagcagtgttcggaggacagagagagagaagaatggggaggggaaggagcggcacatggggttgagcagaggagaaaatcagacagatggcttagagaagccagcagtctgcgaggctggggaggatggagagtggtttggggttttgggtcggggtctaaggtgatcagatgcagaagcattacacagtggcctggtttctttactcagcccctggggtag

SEQ ID NO: 79298 - DNA, 387 bp, Homo sapiens
tcatttagaggtggcatgcttgtagtgacttccaggtaacttgtgcatacacaagcacatgaacacacttcattacatttcatcactgctttgttgcctaaagaattgtttgggcatttatgtaaataagggaagggagtatttcacattagtactattgatgactatatgatatgttttttgagatgctcattatatgcgtccatatgacactggaagtcctacattttaagaatataatgattatgtacctgcagttttattttaggatggacgagaacccataaaatttgctaggtcagtatctttataggaataattgtgccgaaagtcttccaaatggaaaattacctgtcttaattttttaaatgtttttagagtgttttt

SEQ ID NO: 79299 - DNA, 2254 bp, Homo sapiens
ccgcctcacctgggcgccggtgacccttctgcggggctctggacaagcagcagcaggcaggggaggaggcggagctggtcgaggagtggggatcgggggttccctggagtggcgatggaaggcagccctcgctgcatgcttcacattacagagggtgggagggataccgcctgcccgtccctcggccaaagactgatgcgaaggacctgcaaatggggagatggcgtatctcactgacaggacctccaccttggaccaaatgaaagagatctacattccaaaggaaactggctagggagacctttaagccgtgcctactctttggaggagggactctcaactgaagcttctgcggatggttagctgggtggatgtcttcccgcttccttggccgtgattttatcaacttgttactagacagccagcgcactaataatggcagttaatatgcgcgcctcggatgggggcgattcgtaaaggttggcttgtctttgaatctttggggtgatcggatgtctgcagggcctaagctttgtgggccttctgtgctttactcttgggtgagttatgaatgaaaagaaggggactccatggaatgattgcatagcagcccgcagcgtagacagcctgttccgtggtgtccttttccttccttgggtgcagactcaaagccctgccttcataggacagggagagctgtgcagcttgactccgtagaggtgtgcccttacaaagctggaggaggtacccaggcccatgcgattaatcagcagcattgccttaccgggctcttatccccatccgaaaacttctgtagggtaaatagaagaggaaactccttcattgagccctttgactatctatgttaatgcttttggacttaaaaaaagttgtaattatgatctttataagttttagagatgatgctttgctgaagattcctaaacatttaagtcttgctccttggcaacttcttgtctttctttgaggctttcattgtgtcctgatggttttagaaatgtttgatttacagccttctaaaaaaaaaaaaaaaaaaaaaaaagacgctctagcgtggcacttgactttttgaaggagacttttgaagtttgcagtttttatctgcaatgttttaacgtgtcactctttctcaacagtagtttgtctggtgagcgagctatccattatgaggagtgttatgctttggagataatcttgggttcaccatttaatacaaaattagcagtttaaacaccatttgtaactattttatccttgtgagtagagagataatatgtgaatttggcagaaggaatctattctcttctgaaactttttgaagtgcttatctaactcttttgtagtccattagcctagccaaaaaaaaaaaaaagtcaatagttgctaagtaaagtgacttaaatggtatttaataagtttacttgttaagcaatcactaataggtgtccttaattcccttatagctgcagtaatgttggtgagtttatctgagctgtctgaatagtcatttcatggtgcacctcgtatctttagtaactttattgtggtagctgacttgttgaacctccctgtttctgcggacagagtgcagtgtggctttcagggatgtgtgtgtacaaaggctagcatgcttttatgagttctgcaaatactgtttgattgaaggaattggtgtggaccttgtctggcagccctgaaaaagttttttgtaaggaaggctgatgatgttttagggccgctgagagggaatataacattttcttttggtgagaaatgagaaagcagaaggaataaattgctgtccagctttggattaatcatgttttctaagtaacctgaacttttcaaaacctccttttatttactgtctttaaataaaccctccttttgtttactatcttgaaaaacctttataagctttagagatgatgcctatgcctgaagattccccaaacattttatcccacagtcttcaagaatagtttgaatcttaactcttgcctcattgtaacttcttgtctttctttgaggctttcactgtgcccctggtgacacagtctcattgaacttttcaaaacttccttttatttactatcttaaaagaaaatagtagccaggcatggtgtgacgcctgtagtctcagcattttgggaggctgaggcaggaggattgcttgagcctaggagttcgagaccagcctgggcaacacagttagacctggtctctacaaaaa

SEQ ID NO: 79300 - DNA, 719 bp, Homo sapiens
ccgcgtcgacttttttttttttgtattaaaaattctgttctcatctttatttacttccttcattggatttaatctgctgtccattttcaaagttccttggatgaatttttacatcattgatttttagcattacttactttctcttttttttgagacagtctcgctctgttacccaggccagagtgcagtggtatgatctcagctcactgcaacctcttgcctcccaggttcaagtgattctcctgcctcagccccccaagtagctgggagtataggcgtgtgccaccacacctggctaatttttttgtatttttagtagagatggagtttcaccgtgttggccagggtggtttcaaacttctgacctcaagtgatcccccttcctctgcatcccaaaatgctgggattacaggcatgagctaccgctcctggccactttctctcttgtatatgcatttcaagctataaatttttttaagcactctaatctgtgacacagatttgtttaatctattaatattaatttgtcaaacaattggtatatctttagatattaaacactaatattcctctaagtattcttatattccttatgcaaataatcaaacttactgataatgcaataaaaattcccagatatttaaacacgtattgcgaactttaatacttttattgattggagtcataaaatttaataataagtgtttttcaaatgatct

SEQ ID NO: 79301 - DNA, 448 bp, Homo sapiens
gaatcagaccagggttagagtactagctctgttactcacctatctacgtattaaaagtgtctctgtgtgtgtgtatccttagttacctttctaaggcttagtttctctgggtataaaatggggataatacctaactcacaagatgattgttgtaatgaaacagtagataacccatgaagaacagattcttgaggccgggcatggtggctcacgcctgtgttcccagcactttgggaggccaaggcaggtggatcacctgaggtcaggagttcaagaccagcctggccaacatgacaaaaccctgtctctgctaaaaatataaaaattagctgggcgttgttggcgtgtgcctgtagtctcagctacttgggaggccgaggcggaggaatcacttgaaccagggacgcaaagttgcggtgagccaagattgcaccactgtacactccaa

SEQ ID NO: 79302 - DNA, 553 bp, Homo sapiens
caacctcctgggctcaggtgactcttctgcctcagcctcctgagtaactgggaccaccactgcatgctatacctggctaatttctttttaaattatttgtagagacagggtttcattatgttgctcaggctggtatcaaactcctgggctcaagcaagcctctcacctcggactcccaacgtgctaagattacaggtttgagccactgtgtccagccacacggctgtttctatcattctgtattccagagatcaccagttctagtcttctgcaggggtagttgctcaatgtcatgagtaagagaggggaactacagatctacctccttttaagttttgtattaattttttttttaattttgaaataattttagatttataaaagagctgcaaagatggtacagagagttcctgtgtactcttcatcaagcttcacctgttgttaacatctttcataatcatggtgcatttattgaaactaagaaattaacatgagtatgatgctatgaactaaaccatagactttattaggatctcaccagtttttctgctga

SEQ ID NO: 79303 - DNA, 361 bp, Homo sapiens
gtagattagaggcagcccgagtaacccagaatcgctaaaatagaagtgcgagctcattgcccgctgtccttcactatgtttgcatataggaagcaagaataaaacaagcataaaataggctaactagcttgtcagagctcttcacaccaagtctttgtgagttccaataagacactgactattattaaaaagacagagactccacataagtaggaatttattgttttccttttcagtcaccaaaggacaatcctctgcataggttagcaaaaaatggtactgatcctataatctctaatattaaagtttagatttggcaagctgtacatcttatgttgttcattaacaaaaaacaatattg

SEQ ID NO: 79304 - DNA, 654 bp, Homo sapiens
tagacagagtcttgctctgtcacccaggctggagtgcagtggtgcaatctcggctcactgcaacctccgcctcctgggttcaagcaattctcctgcctcaacctccttagtagctgggattacaggcgcttgccaccacacccggctaatttttgtatttttagtagaggcagggtttcaccatgttggccaggctgatcctgacctcgtgattcacccacctgggcctcacaaggtgctgggataacaggcgtgagccaccatgcccggcctaggattctaaaatttttaaaaggcagtcataaaattataagcaacaaattgtttgcaaattattcaaattttctatgtctcacagaggcacttctcctttctttttagcatgataaattcatgaaaatgaaacacagatggtaatggataataaacagctttatccagtgtttgtctgaacaagacaataaaagcttcatcacagtacttaatcactagttcccaccgtccccatataccccctaaacagtgcaaaacaggggaaaaatgtaaagcacccaccactcgattctaatttggcttataatttggtttacttaatatgaataaaaaaatcctgttcagatataagtaacagcatatatgtagcttggatttggt

SEQ ID NO: 79305 - DNA, 2635 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 79306 - DNA, 253 bp, Homo sapiens
ctcaaaaggggccggatttccttctcctggaggcagatgttgcctctctctctcgctcggattggttcagtgcactctagaaacactgctgtggtggagaaactggaccccagggtggtttataaaatcctccaatgaagctactaacattactccaaagcataatatgaaagcatttttggatgaattgaaagctgagaacatcaagaagttcttatataattttacacagataccacatttagcaggaaca

SEQ ID NO: 79307 - DNA, 3052 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaacaaaaaaaaaacaacaaacaaacacaaacacaacaacaaaaaaaaaacaaaaaaaaaaaaaaacaaaacacaaacacaaacaaaatagaaaaacaaaaaaaaaaaaaaaaagaaaaaaacaaagaaaagcaacgagacgcgaggcgggcgaacataaagacaacacaaggcagagagaggaacaacaaagacacacgcaaacaagaagaagagaacaagagaaggaggacacgaagagggagagaaagaaaaaacaaagacgacaagagccgcgagcgaacacacataacacagcaagagagcaaggagaacgcaaacaagcgaagagcagagagagcgcagaacgacaaaaccaacaactaaatgagtagagagggaaaagaaataaggagaaagaagaaacaagagac

SEQ ID NO: 79308 - DNA, 2448 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 79309 - DNA, 2355 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatata

SEQ ID NO: 79310 - DNA, 1901 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagtttaattttcatttttaaattttaccttattgttactatgttttgatgttatttttgtttaatatttcacataactattttttttttttttttctttaatactttattgtataatctttcttttcacattactac

SEQ ID NO: 79311 - DNA, 1828 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataagaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaatt

SEQ ID NO: 79312 - DNA, 1162 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatggtgaatgatcaatccttgaatatcataggaaacttaacatttgaaagagactttattaaagaatttcctttggta

SEQ ID NO: 79313 - DNA, 527 bp, Homo sapiens
catgtaagttccaagaagtataggtcttaagaaagaatatgataatctaccatacgaggttatagtaataggattacacataatgatacaaaaatcagtttctccgatttttctcttgatttagtacaaattagagcataaaaatttcaaagcagactttgaaaatctatttcatgcaataatactaccactttaattttttaacgtatcacacttcaaagtacttttgtgtaactctgctttactttgttgatttggaataaaagttgattaaacattaatatctaaccactttcaatttttgttcaccagtaattttacacagataccacatttagcaggaacagaacaaaactttcagcttgcaaagcaaattcaatcccagtggaaagaatttggcctggattctgttgagctagctcattatgatgtcctgttgtcctacccaaataagactcatcccaactacatctcaataattaatgaagatggaaatgaggtaaaaaataaataaataaataaaagaa

SEQ ID NO: 79314 - DNA, 886 bp, Homo sapiens
agaaaagtaaataataatcgttggataggcttcaaaaaagaaatgcatttgagatggaccttgacaagcagataaaatcttgatttagttgaaggactccatctggggaaacattaatgaaagtgcttaaattttcaatgctaattaaaatgtttatttttaaaatgtttcctttgatcctgtttttctttattaaataataccctggacaggaattaagagcacagcctgaagtgattgtgatgtccaagaagtactactcatggaacaaatagacaacttgtcatatttcaaaattaaatgctgactgcactatgaatatagaaaagtacagttgtaaacactatattctgtaccatgtaacatcttatgtatgatttcagttctttttaagaccaccagactacagttacaagaaagccaagatcagactgactcaatttgcattacatacatgttcagggaaagcctaattagggaaaacagaaacttcaaatttcactcttttaaactgaataggagagtatcttacatccactgccagaaaatatcaccccagaagtgaaaatttacatgttttaatttctgaaataatgactttgaggaaaacagttagaaattataaaacatacaaattcctatttgtcacactatggagactttggagaatatgattctccaagtatcttggtgtttaaacaaataaaaatatagttcagccaaaaataaactagctcacatgaaaaagctgtagtattaaaaactgctacatcagaaagtcgaagtgagtattcagtaaatttattaacaagatatcactggattaatgattctatctcaagtcaaaaacattttgccaaagtgacagcactaacacctaccacca

SEQ ID NO: 79315 - DNA, 563 bp, Homo sapiens
  misc_feature (385)..(385): n is a, c, g, or t
cccacgcatgcggccaggtaccctctgacgagaacagcccgagaaatcgtcccacacgcagccacgtaccttccaacgagaacagcctgagaaatcgtcccacacgtggccaggtaccatccgacgagaacaacccgagaaatcgtaccccacgcggccaggtaccatccgacgagaacaacccgagaaatcgtaccccacgcggccaggtaccttccgacgagaatgacccgagaaatcatcccacacgcagccatgtaccttccaatgacaacaacccgagaaatcatcccacacacggccacataccttccgacgagaactaggtaccttccgacaagaacaacccgagaaatcattccacacatgcaaccagatcacctcnatccaggaaggcgtctttgacaatgccacagggctgctctggattgctctccacggcaaccagatcaccagtgataaggtgggcaggaaggtcttctgccaagctgaggcacctggagaggctgtacctggaccacaacaacctgacccggatgcccgccgcagcctcaggtgccggt

SEQ ID NO: 79316 - DNA, 828 bp, Homo sapiens
accctcagtagggcggggccggggccgggccgcggggcagggacttctgcgcgccgctgctcgcctggcccactgggcttttcgcatctggggatctggggccagtggaggtcagccaggtccgcgagcaacctgtgctcaggccagcggaagcctgactccaggattcggtggtgccacagacagttactgaacgccaattttgtgcctgctttaagcgaacaggacagttcctgaccctcagttctttccaggctcttcactactctgcctgccctggaacttctcagatcacgtcagctccctctgcccaggggaaaagctacaaaaggaagagttccaagactgccaaataaagataaaccaatacgctttaaaaagtagaatgtattggtttatcagatttggggatgatgcctttcttcaaactgccctttcctgtttcacccaagagacctggtttctaggcccttctccagagtttgccctgtgtccacatccttctcactgtggtccttgcgactggacattccccttcagctggctcttttttgggagcccacctggcttatccttctctcataacgtttattgaactttattttacctggcctcctgtccaggctacatctgagaccatgcaggagctgtggagattaacggtaaaaggaacagcacattcaagactcttctaggaggtggggcaagatagccaaatagaaccctccagtgatcctcctcctcctcttccctggcaggaacaccaaactgaacaactatccacacaagaaagcaccttcatgagaaccaaaactcaggtagcaatca

SEQ ID NO: 79317 - DNA, 540 bp, Homo sapiens
gcggcccctactactactactaaattcgcggccgcgtcgacgtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgacaaatatagcagggtaatgtaagatgataacgttagagaaactgaaactgggtgagggctatctaggaattctctgtactatcttaccaaattttcggtaagtctaagaaagcaatgcaaaataaaaagtgtcttg

SEQ ID NO: 79318 - DNA, 2124 bp, Homo sapiens
gatgaaacaaatacttcatcctgctctggaaaccactgcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcccccagctcatggtcacaagcaatccaaagctggtttgatgagtacaatgattttgactttggtgtagggccaaagactcccaactcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtcctctcccttgtgagtcttcactaaaatcagtgactcacttccaaagagtggagtatggaaagggaaacatagtaactttacaggggagaaaaatgacaaatgacgtcttcaccaagtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgacaaatatagcagggtaatgtaagatgataacgttagagaaactgaaactgggtgagggctatctaggaattctctgtactatcttaccaaattttcggtaagtctaagaaagcaatgcaaaataaaaagtgtcttg

SEQ ID NO: 79319 - DNA, 438 bp, Homo sapiens
gcggcccctactactactactaaattcgcggccgcgtcgacgcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgacaaatatagcagggtaatgtaagatgataacgttagagaaactgaaactgggtgagggctatctaggaattctctgtactatcttaccaaattttcggtaagtctaagaaagcaatgcaaaataaaaagtgtcttg

SEQ ID NO: 79320 - DNA, 2092 bp, Homo sapiens
gatgaaacaaatacttcatcctgctctggaaaccactgcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcccccagctcatggtcacaagcaatccaaagctggtttgatgagtacaatgattttgactttggtgtagggccaaagactcccaactcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtcctctcccttgtgagtcttcactaaaatcagtgactcacttccaaagagtggagtatggaaagggaaacatagtaactttacaggggagaaaaatgacaaatgacgtcttcaccaagtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttagacttaccgaaaatttggtaagatagtacagagaattcctagatagccctcacccagtttcagtttctctaacgttatcatcttacattaccctgctatatttgtcaagat

SEQ ID NO: 79321 - DNA, 460 bp, Homo sapiens
gcggcccctactactactactaaattcgcggccgcgtcgacgaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgacaaatatagcagggtaatgtaagatgataacgttagagaaactgaaactgggtgagggctatctaggaattctctgtactatcttaccaaattttcggtaagtctaagaaagcaatgcaaaataaaaagtgtcttg

SEQ ID NO: 79322 - DNA, 526 bp, Homo sapiens
ccagtgctggcttcaccaaagccagacaggggtggacactgctagcagctcctgtattctgcccgtgggaagcaccagggtatggatggaaggctgagctgcctcctgcagccccctgaagctgtctctgctccaaggcacaaaaatcagaggtcacagctctttgcagagggtgaccttgtgcgttcatgtccctctggatttcagcaccaacttgtgccccttgttgccttcagtgcagaaagcagccacagctcagtggcgactccttcccctgccactgccctgtccctggtggtgtccccagattcacccttttgcaaacagagcctttgaaagtagccttgcctgactggcttcttctccaaatgacatctgtttcctggtgggaccctgtcatggtgatagaaaatgttcaaggttttggtgaattcgagagggcaagttctacccaaagttctagatgttaaaaaataaaagtaaaaacaaacactgggcaaagcaagaaatccatgccctctgacta

SEQ ID NO: 79323 - DNA, 746 bp, Homo sapiens
agcggcctacttttttaaagccatcatcttatcttctagctgtacctatttttttaaatatatgttttatttcaacagcttttgggatacaagtggtttttggttacatggatgaattgtctagtggtgaagtctgagattttgctacactcttcacccgagtgaccccagtagtgtacattgtatctaatatgtagtttttttatcctttatcccctcccaccctgtatctatttttaattgctttgtgaactaaggcaaatgtgataaagaggcatctgatgtacctgcttctagcatacaagaaaacatatttcttgagcatgctgttacatgcttgacactttatatacactatttcatttaacatcccaacaatcctaaaacctgggttttgttattgaagaacccaaggctctgagagttaactaacttgcccaaggtcacacagttagcaagttgtgtgggcaggatataagcccagtctggctgcaaagctatgttctttacactgtaacttactcctgaaggaaggaggcttaaaaataatccatgcagaatttgtatcagcttgatatgtgtgccttattattattattattattattattttgagacggagtcttactctgttgcccaggctggagtgcaggggcgtaatctcggctcactgcaacctccacctcctgggttcaagccattctcctgtctcagcctcctgagtagctgggattatgggcgcccac

SEQ ID NO: 79324 - DNA, 146 bp, Homo sapiens
tttatactctatatttcaaccattagaggaagagagacttccctcaagtttatttgtctgttttggcctcaagttcaaactctcagggaatgattatattggctgtgttgcagtcgggtgtcttactcttgcacatctgtgagaag

SEQ ID NO: 79325 - DNA, 393 bp, Homo sapiens
gggaaaatggaaataaactataaaagccaaagtaaaacccaggccctgcatggtacattagtacttccccaaggacactgaattgaacaaaatttagtaactctgggtatactggaaaaccctttacaaattaacccagacagaaaaaaacatcaaggcctctgcaggtgtttggatatagccagagggatggtgtctgccgggggtggaaggtctgtggcttggataagcagcatatcaaagccaggtctggtaggcagggagctggccccatatctacagatcagaatggcagcatcgttggacatggggtattgtaagaggtgcccagaccaaccttctagaaaagttattaaagttttccagttgccttctgacatatatctgtgtagc

SEQ ID NO: 79326 - DNA, 674 bp, Homo sapiens
ggagttatttaaggcaaagaataaagtgaaaatcctggggtattttcaatattaagccactcaaaacattgtactgttacaatgcaagtttactgtgaactgacttttttttagatagcaatagctatttaggtttttttcccttatgatctcttcaggtcctcattgagatatagtttaggatctgtcagaagcaagccagtttgcatggaagtcattgtttcaggttcactgtgaccagatgtggtcttcctttaaattggtgttaattggaaaaagtaacacttttagaattaagaaaagctctgaatccattttctcctcgaagcaattgtgattggtctcacctcacccccactgatgtgcatgtggaaggttctgcctttctgcattaagtgacagcggagagctgcctacatcccccacccttcaggctgtttacagacactgagctgtgggactgattcacgggcatcattgaaaactgtctgagatactgcttttatcactagttgaagttggatagataacatttggtgctttaagtagttcatgtaaaatcttcatacatttcacgagtgcacttttagaaaaacaataatgtgacctgatgatgtcattctgagtttctcaactgctcagaagaaccgtggagctcttaaatttgaaattat

SEQ ID NO: 79327 - DNA, 976 bp, Homo sapiens
ctgcgccctccttcccaggtggacggcggctctcctcgccatcctctccacttccagcctatcatctgtctgcctgttacatgtttgtaacttttgacctttaaattggtataaaaatggtactgtaagttcactgaaccaagaaaatctgctgaaggaagggggtcagtcacacccttttggggtttccagtgtatgaatggagggggtggcggtggtggagggacagggagcaatgagagttgccagccttattgctgtcctgacccctggctggggacgactcccctgtctccacctgaattgaagctgggctgtgaaaagtagtaagaaccctcggtttttggttcctttttcaaccagcaatcagccatgaagtgcctgaccacttgagagctacagcaggtgctgtctcggagagggcacaggaaactgggcccttcccaattttagcccaagggtgccgaaaagtcagggagctgctggcctccacactccttcccattggtgtggtccgaattcccctttagccagacatttccaatgtccagaggcccaggaggggacagctggaagccagaagcccacctgacgccatcaggaatttccatgaatgacctggaaacctctcagactaaaccaatgccgcccaatctgggaatccaggagggctggtcccatagagtggtggggacatggtgctgagacggacagcctcgcctcatccgctctttcccacttgccagccgggaggcctgggcaaaatcactttctccccagggaagtggaggctcactgtgcagtccacgcggagcaatggggtgaagtttccagagcagggcagggcatgtggggaggctcaggaatgccacccttgccctcaggcctgggcacagcatagcccccatgacgcttctctcatcctggacccatcagcccggaagactctggaagcagcagtggcagcaccttcctg

SEQ ID NO: 79328 - DNA, 401 bp, Homo sapiens
aaatgtctgtcaggtctatctggtgtatagcgttgctcaagtcctctatttctttgaacaacagtatacaccaaatagatgtgatagacaccaactaggcgtgatagaaaaaaacagcagaatatatactcttttcaagtacatatggaacattccccaggatagattatatgctagggcataaaacaagtctgaataaatttttaaaaaattatacaaagtatggtctccaaccacagtggaatgaaatgagaaatcagtaacagaaggaaatttagaaattcacaattatgtggaaattaagcaacacactcttgagtaatcaatggtctgaaaaatgccagaaagattagaaaatgctatgagagaaatgaaaatgaagataaaacatacgaaaaatt

SEQ ID NO: 79329 - DNA, 444 bp, Homo sapiens
gtccgtcaagctgccctgcaccagctgtttgaaaaggagcatcagcagtaccagcaggaactaaatcagatgggcaaagctttttatgtagagagattctgatggcatccaaaacactgctcttccattctcaacatgcctgctaacctagccttctagaacctctaccaccttgaacctccttcccaaaacatacctggatcttgctatctgtcagggacttaagacagcacttccactctcacttctccactctctcgttaatcctttgccgctatttgggaaacaatctatgaaacaacagtaacaacaagagtgacgccttgtggtcatagtgggatttactatgttgatgtaagggggcaggggtggggaggggtggacaatgagagttgagaatcctgatttggtataacaaataaatttacttcctaaaggctcaaa

SEQ ID NO: 79330 - DNA, 737 bp, Homo sapiens
taaatagaggcaagggtctctacgttggccaggccggtctcaaactcctggcctcaaatgactctcctgcctcggcctctcaaagtgctgggattacaggtgtgagccagtatgcttggccttttcttttttcttcttcttctttttatttttcgagacagggtctcgctctgtcacccaggctagagtgcagtggcacaatcttggctcgctacaacctctgcctgccgggttcaagtgattcttgtgcctcagcctccaagtagctgggattacaggcacctgccaccatgcccagctaatttttgtatttttagtagagacgagggtttcaccatgttggctaggctggtctcgaactcctgacctcaagtgatccgcccgcctcagcctcccaaagtgctggaattacaggtgtgagccaccgtgcccagctccctggccttaaaagtcatgtaatttaatgatcagaccccagtcacagccataggatacaaagaagcaaaggcaaagagccctgtgtcctgggcacggttacaggccagtgtagggaaagagcttctgcttgccagtgtgaagaacagaggagtttaggaagtgtgagtcaggctcagcttagtcaggcagagaccagtgggcatgggttacctgggggtaacgcgggccaggtgggcgggctggcagcctggggcccatttcctgccaaagcacctctgaccatccttctcttcacccag

SEQ ID NO: 79331 - DNA, 176 bp, Homo sapiens
ggctgtgggtccctgagcctgccctttgatttcagagctgttgactgacacagggctgaatggttcctgccagagtcctgaatctggtggcctgtgtcttttctgtgccccattcccgcaggggggtgagccatggtgtagttctcacagctcgccctcctgggcagagaaggtac

SEQ ID NO: 79332 - DNA, 745 bp, Homo sapiens
gtatacgccagcagtggagctcgtggccacccagcccctgctcagacaggaggctgcggcccaggactgtgtggctggtgggggccaggttgggccaggcctggggctgccccgtccttgcctccctgggcccatgagcatcaacgtctctatagagaccaaggaccctggattcctccagtgacaggggtttggcctctggacagagaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactcggacagctgggtggcctcaagctggacaccccttccaagggctggcaggcaaggaatggtcaccccaggaacctcagggccttgtctttgggggaccagcccctggtgctcctcccttctccggagtcagaggccaacagcgtggccagggacaccatccagattaaggacaagctcaagaaaaggaggctctcagagggcttggcagcgtcttcccg

SEQ ID NO: 79333 - DNA, 399 bp, Homo sapiens
agcacttctctgcagaaagtaggccttgccttgtgtcttgaccatctctttgacttgactggaaacattctctagttgtagtccagctttgctttagatttactttgcttttttgttttttggtataagtggccctaaatacagcagtcaaactggagtaatgagaaataagttacctcattgtaagtttcctttggatgttctgcttaaaacattggctttgatgaaaagaaaggaaaaacacatgaaaatgtaatgcggggagacaagtttattaaaagccgtgactacggaaaatagcatccttaagcttgatgacttaatttcctctctgcttttattgatcactttattatataaggcaggattgatagcaggatgcatcggatttccaattat

SEQ ID NO: 79334 - DNA, 359 bp, Homo sapiens
cttctaagtagctaggactacaggcccccactatcatacccagctaattatttatttttcctagagatgggtcttgctatattgcccaggcctcaagtgatccaccagccttggcctcccaaagtgttggaattacaggtgtgagccatggtgcctggcccaaattctttttttctaatgcataagtattactttgtttttgaaagtggtatggtgtttaaattgctgaagaaatgataatgataaggtgattactttagccttcacctggcttttcatctgggaattagtacattcttttagtgaagcaataagtgtgtggtgtcaccttattatatattttgtagtactgaaaaatg

SEQ ID NO: 79335 - DNA, 538 bp, Homo sapiens
ggaagagcaatcttgttaggacctagggcagcttgtgtttcttctccgctcgccatcctccaatgcctttccgtcttcttcagagtcaaagctaaggctctatgaacaggctgcccccctgcaggcccctccctcgcaccgctctctccttcctctccagccagcgctcaccttccagcctccccaggctttgcttctgtccaagcacaggccacactcaggctccttgcttcactctctattctattttcctacgttacttttcttgagaacaacatcaacgtggttctatttggttttgatttttaaatctaactctcccactagaagataagctgcatgatgctgggcactcttttgtagtcacggctgtgtctctagcccctagaacaggagcttacagaaagcgggcattcgatacatatctgtgaatgagtgagagtgtagaaagagaggaagatgcagtgaaccaaacaggattccataaacccagcaggaagcagggtcgatatggctaaatgaaatcaactggcttcca

SEQ ID NO: 79336 - DNA, 754 bp, Homo sapiens
cggagtctggaggacccctgattccagacgttggtgtttaaaagttaaggcgaatgtggaaacacccgaggggaactttctcatgcattagcgcacctcgaggtgggaggggaagcggtgactgtcctccctccaccagccgtcgcgggaacccgtggggttcagtgaagggtccagcagttcaggtgcccgccccgggcctgggccttggctccgggctacagtgtgagatcccgggctaggtggcccgcctggggcaggtcgccgggacaaccccaccgccccgcaagtccagcccggcctcgggcacgccaaaggattcctagcaagtacaagcttctgacttcacagagaggccatggtaaacatcccaaggagtgcatcagccatgggttcagggatttcagccactgcatagaagacaagctgtaacctaattcaatcacacttggcagcaaccggtgaagaggcagtctgggctctggggagctcccccgtgacagatggaaggggcccctacatctggagaggctctagaacctcctcccagtgaggctaacgtggtctgaaggggtctctttgcccagtgacattctggggttgggatctgggatttcctccattgcttccttacatcaacatttgctaaagctcaaaagaagaccttccacgtaatgacatcaaacagatctgaaaccacagttaaagtaacgtccacttaacacttggtcagcactcatgtttcattttgtgt

SEQ ID NO: 79337 - DNA, 557 bp, Homo sapiens
gtttccccagggcccctccccttgaagaaattagacaggaagctggagtagatggttccctctttcccacctctcacactcccaagctctggttaactctctgtgggccagtggctagattccccaacacagatgacaactgaacaatacacatgcagcgtaagaatgttgtcactgccaccagccacttacagatacaccattgctaaggtccacccaactggactgtttcccccttccatagactaagccccaaaggccaaaaataaaaccccctaccccaaacctgcctataactgtttgaccagaggccagctgtcccaggatgcggttaagatgtctaccttgcacaacagaactggcaagaaaaacatctccaggaagcggtcagatacacggcacaaaggactcccccctccccgcttttccttttccttcaccctgacccagttctacgccctgtaagacgttgctccagcctataagtggggctgcctcctctgcttttgtcaagagatagcccggcaggactgacaataaatcagtttgcctgaact

SEQ ID NO: 79338 - DNA, 136 bp, Homo sapiens
ccagccccagccaactcccggcactgaacactacagggaatggacttccggcagatctcacccaccacctgcaccaccccagccagcagcagctctgcagccccgcccaccccagccagcagcagctctgcagccc

SEQ ID NO: 79339 - DNA, 573 bp, Homo sapiens
attttctataatttggatgttatgtatgtccactgtgtctgtgtggagggaggccaccacgtgatggtttgctcgtgcgtgtctcttcctgactctgagctcgacaccgtcaggttgatagctggaaatgggccacggtgtgaatatttacaccattgcaattggcaaatgctgtaaatcaaggcttgacttatggttctgttgattattcttcacagtgatgttagtaatacagattaaacttaacagtgcattgtacctgtagccattccattgtgaataacacaaaaagtggaggaaatatttttctcgcatttggaaattattctgtgattcagcaaagaagttgttcatgtcattaacaagttcagaaatacatgctgccaaagccaaaaagagtcttcagtttaataaaaataattaacaggaaggtgagaaatggtttaccagctgttcacttactggatttaaggttacttgttggggaaagagcagagtaagatgcaactctgtcaaatcatggctgaatatgtttggcaaaaaatcaataaaaattctgtgagcatcaaactg

SEQ ID NO: 79340 - DNA, 486 bp, Homo sapiens
gagcacttagtcatagctagactggtcctgcaggggtggtggaaaatgactggattctggatatgttttgaaccgacatccaacaagaatcactgttgaattagacatcaagtgtgaacaaaagaaaggagtctttgaaagagtcttctttgaaaatactgcaaatgagcttttatttctgattttgatcctaatcctaggggagttcaacatgatggagacattgtttaggcattaggcattagactgttgtttcctaaattgcttcctgagtaaaccaattaaaattataatgtgggtctccaggagaaaagggaaggagccaaacttggtacaatttcacctcttaaatgccacttaacggcacttttctcctattgcttggggtaatgaaatttctgggcaaataggggcaaaatgaacacaggggccctcatgtaggcagcccatccctatttactcacagctgtaatgctacctgatggt

SEQ ID NO: 79341 - DNA, 222 bp, Homo sapiens
ggccctgcccagattccccagctgcgatgctcaggaactcagggggagaaaggtgaccaggtctcatggagaggattaatgtgcggaacacgcagccgctccagatcccctggagaggatctcgttcccgtgaagctggcagctcccggagggctgagtgcttgtttctgctctcactgtgttagctgcctacaagcgtccccgctggcctttgccttaccg

SEQ ID NO: 79342 - DNA, 392 bp, Homo sapiens
tccccccgccacttccctcctcctgctccagcctgcctttcctgcacagcttctggctgcttctaggcactggaggaggaattcatcaggggctgacaagtggcaaatgacattagctgccaactatatttttttaaatgtgaacacaaccggggtaatgtcttattcccttctccctgtttccagtccctgtgcctaacaatagtgcctgaatcctggtaggcacatggtatttcgaattcctccgcggtgggcatttgtcattttcggctatctctcgttcctttcctcttcttctgttatcaaatgcctttcttttcttttgaggagccactcccttccttcaatttatgtggttctggggattaaaggagctaattctgtcaaattct

SEQ ID NO: 79343 - DNA, 170 bp, Homo sapiens
gtgacagaattcactgtcaccgttgtctttaataactcctatttttactgttcacatctagcactgcaccaatggatgagctgagaacctcttcaaaaggaacttgtgaaaaatgtaaaggaaatattactgctaaataggcaaggctaatgttcttgcaattgtggaaa

SEQ ID NO: 79344 - DNA, 377 bp, Homo sapiens
  misc_feature (48)..(48): n is a, c, g, or t
gagatgaggtctgacgctgtcactcaggctggagtgcagtggcacgantcatagctcactgcagcctcaaactcctggcctcaagtgattcccctgactttgtctcctaagtaactaggactataggcatgcaccatggacttccagctaagaatttaagttaaaaaaaacatacatatatacgtgtattaatgtagacaaacaaacctgaaactgtctttaaaaactttgttttgctattatgtgaaatttaaaattgctgtctaaaatatttattcacaggtatataatagtaaatataacctctatataggcagttatgtataataaaaacagcttttattctattcttacacaagatatttttagctaaccac

SEQ ID NO: 79345 - DNA, 431 bp, Homo sapiens
gacgccaggaacctctccaaatactttagtattttaattcaaaaagctgaatccttacaacagccatatgtggtatttttcagatgagaaaactgatgtacatatagtaattaatttccctatggtcacactactagtgagatgaatccagcatttgaagccagatagactgcttccagaagccagatttgtaactctcaccaattcacttcctggctaaaaaccttcaatatctccctgtcttttacagaataaactaccctcttattagaagagcaaaaaagtccgctgcattttatgactcctacatatattttcagatacttatcttttggatccccaaagccattctcatcttgaaacatttgtcattctaacacacactgttttatcatgccactatgtgtatatgttttctctgcttgagaggc

SEQ ID NO: 79346 - DNA, 2985 bp, Homo sapiens
ctaaagcagaccgcgggttaggggcttcatctctctgcgttctcagttgtgggaggccttggtgattcggccacagcctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttgagagaaatcctacaaatgtaaagaatgtggcaaacctttggatgatccacaaaccttaatgaacatgagaaaatttatactgtagagaaaccctggaaatgtgaagaacgtggcaaagttctttacctcattctcaaaccttgataaacataagagaattcataccggagagaaactgtacaaatgtgaagaatatgcaaagcctgtgaatggtccacaaacctgaatgagcagaagaaaattattactggagataaaccctgcaaatgtaaagagtgtaacaaaacctttaaacagccctcaccggtgaataaacataagaaaaatcatgctggagggaagccctacacatgtggcagaatgtggcaaagcatttaattggtcctcaatgcttaataaatataattcatgctggagagaaacttcacatgtgaaccgtgtgcaaagcctttaaatggtcctcaacccttaatgaacgtaagtgaattcatgctggagcaaaaatgcttcacatgcgaagaatgtggcacagtctttaccacatcctcaaactttgttaaacataagagaatttataccagagagaaaccctacacatgtaaagaagtgtgcaaagccttcaataggttctcaacccttactgtgcacaagataattcattctggggaaaaaaatgctacaaatgtgaaaaacgtggcagagccttcagaccatccacaaacctttatgaaaattcatatttgagagtagaagaatcattccacaaacttacattgagaagatatgaaagatgaatataagaattcatcctagatataaaaccatagaaatgtaaaagatgtgacaaaacctttaagccatactccaggcttcttaaacataatgagaactcatactggaggaaagtcttacaaatgtgaagaatgtggcagtctttaaatcttcctcagtcttttctaaatcatgaagataattcacactgaagagaaactgcaaacgtggagaagtgtgacaaagcttgcaaccacactcaatctattctaaatataagagaaagtatattggtgagaagccaccaaaaatattgaaaaatgtgcaaagccttcaaatgcttgtcacatcttactgtatatatataattcctactgaagaaatcccctggaaatgcaaaaaatgtggcaggatttttaccaatgctcatctttttgcacatgatatcctttatattcgagaaaagttatagaaatataaaaaatatagaaaagtcatatctcctcacattttactaactagcaatgttcatacttaataaaaacattataaatgtaatttctgttgaaagacttcagaaaatataggcctttaaagtgaagaagagtattcttaagacaacaatacactttag

SEQ ID NO: 79347 - DNA, 487 bp, Homo sapiens
aagccctggaaaccatctctcattcttccaaagatgttcatcttgttgcaaaggctcctgagtggccaactgcagcctcagcatgagatgggtttgacactgagtctccccttgcagcaggagactcccagtgcttggtcctttaaaaataaaaataaaaaacctcctctcctttataccccaagtctgtgacctgtttctgcctgtggttctgttttctaggtaagaatgagctctgtgggttaatcagataagaacctcacatcatctgtttcccattaatctgtcacagctcccaggagacagatcccaaggcgtgcatgtgtctagaaggcccttaggtctcggctgagggagatttcttaggcaggtcagcctgtcagcctctgcactctgtgtgggtagctgcctctaaggggccttccatcagactggaattgacaggtgtgtccaacccctgtcccccctggacccctctgccacaaaa

SEQ ID NO: 79348 - DNA, 247 bp, Homo sapiens
gtctccccaggccaccacctggctgcctaaggcccacgcacctgcaggctctgtgttcttaggtgtctggtggcagattctcatgcctttgtgtgagacttgtctttttcttctgaaagttttgtgggacttttttcatctccctgctcagggcttggtgggccctttgcattcgaagattcttgtctgcctttagctctgggaagcggctggcgccgttcagggctgggagccgctctgtcaggat

SEQ ID NO: 79349 - DNA, 363 bp, Homo sapiens
cctctgactcattgtgatgagtagggcggagggcttcactgcctcagtttccccaactttggaccttaaatcctctcctgatgcctctcagcccagccaggaaggagagctaagaccaagagggatttaacagatgcaggacacacagccttgtcctcagaccccccaagtctgagagaagcaaaacactcaccttgagagccctcggacttggaggtgaggtgcagaacccaggctgggtgtgtgctgaggggtggtgggggtgggtggtgctgggtggctggcctgggaatactttcttaagctaaggctggggcttaggggaggccagaggaagggtaatagtttgcctgggggtgctgg

SEQ ID NO: 79350 - DNA, 295 bp, Homo sapiens
tctcaatactactttgccaatatttgagtcttaccataatccaatcacaacattctagttccgacatctacatttaaacatctataatatcatcaaattgtcttgcaatatttctctcatgcttaagacgtgcaaccttgcatttccaaggaaaaatccataaacttttttagaagcatatgttcaaacaattcagttagaaaataggcaacggacatgaaaagatatttcactagagagcataaagatagaacataagtacatgaaaagatgttcaatatcattagccatcagg

SEQ ID NO: 79351 - DNA, 366 bp, Homo sapiens
caaaattataaagaaaatactgcatattgcttcagcagtgggtgctacagtcagactattccgactaacatcctgcctctgacactttctagtcatgtaacctcgggcaagtttcttcagtgtccccacttaaagaataggaataatcacagggcttatcatacagcatctatgttataattacaccaggcaatgcatgcaaaacacttaacagtgtctagcacataatggcgcttaataagtgttagctactagtaaacattagctgttaatcattagcctcattgttaggtccacgttctcactccagctgttttactttctgccttgacattcaatttattacttcttctgttgcatgtatcc

SEQ ID NO: 79352 - DNA, 407 bp, Homo sapiens
  misc_feature (34)..(34): n is a, c, g, or t
  misc_feature (53)..(53): n is a, c, g, or t
  misc_feature (61)..(61): n is a, c, g, or t
  misc_feature (272)..(272): n is a, c, g, or t
  misc_feature (345)..(345): n is a, c, g, or t
  misc_feature (397)..(397): n is a, c, g, or t
gcggggcctgctcccagacccccggctctctccntccccagttcttccaggangggctggntagcctttagacacttgacccctgcacccctgtctttccccatagctcagtgaagagaggaaggacaggatctttcaaagggaactttactaagaaacaaagcaggatgggatgaaagctgaggagggtgatggtacagcactgagatcccgggccctgcctgccccacacgggtcatgatgagtggtcgttgttaccttttctgctgggnctgggtcctgcctaggagctgaagacacagtcagccacgcctcttccagcccacgtgttcccctgagcaaagnttcttcctgcagaaagaatggggggagattccccaggacatcaaaagtcaanccttcagaat

SEQ ID NO: 79353 - DNA, 690 bp, Homo sapiens
atcattaaaatgctttatctcattggttaactgtgtgtctctaaaatttttactattttaagccttaggtagaatttggtcatacctcactttgcctctctttataaggtataatactgcatattcacatatgtataaatatctatatctaaagaagtattttaaagagtatcttaaactttctggcttttgtacactattctatatataacctttaatgaaagttttattgtaatcgtatgctacagtggtacatttaatcggtgtaaaaaattgttttgtggaaaaagattcagatttttgcatttaattccatagctggaattcgtgggttgatcagtagttcagtgttttgaaatctgtgttcctcagctactttgctgatgttaccagtaaaacattgtgttttgtttctttctttgtttttgagacagggtcttgctctgtcatccaggctagagtgagctgagatcacaccactgcactccagcctgggtgacagagtgagaccccatctaaaaaaaaaatcagttaatcctgagtacagaaaccacccagaagcactttataatcaaattgattaaagtcagtgataaagaaaaaaacaacagaaaaccaaagacaaattatgcacagaggaacaaagagaggatgacagcaggtttttcatctgaaaccttgctgtggata

SEQ ID NO: 79354 - DNA, 4657 bp, Homo sapiens
  misc_feature (1043)..(1043): n is a, c, g, or t
  misc_feature (1140)..(1140): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79355 - DNA, 4711 bp, Homo sapiens
  misc_feature (1043)..(1043): n is a, c, g, or t
  misc_feature (1140)..(1140): n is a, c, g, or t
  misc_feature (4665)..(4667): n is a, c, g, or t
  misc_feature (4675)..(4675): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaaaaaaaaannntgcctgtngacgtgcagaaagaacagacacgaccagataggtca

SEQ ID NO: 79356 - DNA, 4593 bp, Homo sapiens
aacatggtcatttttattaaagtaaaaaataagatagtagtagctctggacatttggaaatgtgtatgtttgtttacaccctgtgaaaagtagacatggtctgcaaaagagccaatctcctaaatatatttctttctctagaaatgttattttgggacaaatgaatgaatccctgttgggaaaaaagaacctgctgcatatcatccatattttattttattattattttttttgagatggagtctcactctgtctcccaggctggagtggagtggcacaatctcggctcactgcaacttctgcctcctgggttcaagcgattctgctgcctcagcatgcccagtagctgggattacaggtgcatgccaccacacccggctaatttttgtatttttagtagagacggggtttcactatgttggccatgctggtcttgaactcctgacctcaagtgatccacccgcctcggcttctggaattacaggtgtgagccaccgcacccagccatgatccatactttaatgtgggttctggattgcttcctaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatgtgagtttttctactgaaacacattcagaattgaaaagaacaaagtgatggtaaaagatatgataccaagttaaacatccccatccgtgtcctctagcaggaatgcgagatagcttatttttagaactgattctttgtcccatgtggctttctttgataccctaaaagttctctttagataattctaatgctgatgatttatgtctccatttagacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggtagttcgtttttaccttatttttacctaaaaatcaaggcctgggcttgctaccttttcaaacaatttttgttatactttctttgctttccatattaacatatcttcaatttcaaatttgaactccttttcttttacattaattggcaactgcctgctttgagtttagtgttttcagttatgaatgaagcttaaatctaacacttcacatgcttgcaattgctcgctattactcttttatatgcaaagaaaagctttttggacagtcaagcgctcctctgtgcgactaggcttcacatacagctcatagttagatacattttatattcacacagtaaccagtagttttggaaaatagtctatgcatggtccaaaatacttgttactgggtaactagcagtagcaggtgcaaacagaataatagaagtggtagtctgagtattgattatttttatgtttgaaaacacatattgaactaggaaaagcatcatttcttttgctgttttgctaagggaatacatctggatctgagacagaaaatggaatttaatgtgattgagatgatcgtgtgtcattagcaccataggctatgaaaatattcccaagttgcagattcaatattcagcaagtgatttctgaagcacttactcttgccagatactaattattctaggctctgaagatacagcagtaaacaaagtgacaaacagctctactttcattgaccttagctggaggagacataggtcaatagataaataatttttaaaaatatctaatttcttcagatgtctatacgtagtactgaaaaatatgccaaagtgaagggtaaatgcatgaaatgcataatgtgtagagggtactgtgtttaattagcatggtcaggaaagtagagagaaaatgtttacacttatcattgcagcatctccttcctttgcttgtatgtaacactagacatgtgtccttttttcaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacat

SEQ ID NO: 79357 - DNA, 404 bp, Homo sapiens
  misc_feature (67)..(67): n is a, c, g, or t
aaaggaaagaggaagccatttgcgttatttcacgttgctgagcctttctctcatgttgaacaatctnaagttttaattctcggtagaaataatgtataaacattctctgaaaccatagcagccataaacagtgctggtcaaagatcctatttgtactcctttctccccccattgttagtgaggtaaagtaaaacaggtcttagtaaaatctcacttttctcctacttttcatttcccaacccccatgatactaactattacaacccctgtttcctggtacttatcaaatacttagtatcatgggggttgggaaatgaaaagtaggagaaaagtaccaggaaacaggggttgtaatagttctaacttttttgacaattgctttgttttttctaaacttgtaatag

SEQ ID NO: 79358 - DNA, 4871 bp, Homo sapiens
  misc_feature (1043)..(1043): n is a, c, g, or t
  misc_feature (1140)..(1140): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatgtgagtttttctactgaaacacattcagaattgaaaagaacaaagtgatggtaaaagatatgataccaagttaaacatccccatccgtgtcctctagcaggaatgcgagatagcttatttttagaactgattctttgtcccatgtggctttctttgataccctaaaagttctctttagataattctaatgctgatgatttatgtctccatttagacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79359 - DNA, 3532 bp, Homo sapiens
aacatggtcatttttattaaagtaaaaaataagatagtagtagctctggacatttggaaatgtgtatgtttgtttacaccctgtgaaaagtagacatggtctgcaaaagagccaatctcctaaatatatttctttctctagaaatgttattttgggacaaatgaatgaatccctgttgggaaaaaagaacctgctgcatatcatccatattttattttattattattttttttgagatggagtctcactctgtctcccaggctggagtggagtggcacaatctcggctcactgcaacttctgcctcctgggttcaagcgattctgctgcctcagcatgcccagtagctgggattacaggtgcatgccaccacacccggctaatttttgtatttttagtagagacggggtttcactatgttggccatgctggtcttgaactcctgacctcaagtgatccacccgcctcggcttctggaattacaggtgtgagccaccgcacccagccatgatccatactttaatgtgggttctggattgcttcctaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79360 - DNA, 3026 bp, Homo sapiens
aggtatacaccgttatccgctcaatgatgccaacgctgatatacgaatgccgcactgaattattgctgtgacaatgtttccatgcttaatgattgcaccaggataccaacatgagttgtcgtcatggtttcgcctgctgagaccacaaacagcgctgtgtactgttacaacccttacgtgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79361 - DNA, 5843 bp, Homo sapiens
  misc_feature (1043)..(1043): n is a, c, g, or t
  misc_feature (1140)..(1140): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatgtgagtttttctactgaaacacattcagaattgaaaagaacaaagtgatggtaaaagatatgataccaagttaaacatccccatccgtgtcctctagcaggaatgcgagatagcttatttttagaactgattctttgtcccatgtggctttctttgataccctaaaagttctctttagataattctaatgctgatgatttatgtctccatttagacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggtagttcgtttttaccttatttttacctaaaaatcaaggcctgggcttgctaccttttcaaacaatttttgttatactttctttgctttccatattaacatatcttcaatttcaaatttgaactccttttcttttacattaattggcaactgcctgctttgagtttagtgttttcagttatgaatgaagcttaaatctaacacttcacatgcttgcaattgctcgctattactcttttatatgcaaagaaaagctttttggacagtcaagcgctcctctgtgcgactaggcttcacatacagctcatagttagatacattttatattcacacagtaaccagtagttttggaaaatagtctatgcatggtccaaaatacttgttactgggtaactagcagtagcaggtgcaaacagaataatagaagtggtagtctgagtattgattatttttatgtttgaaaacacatattgaactaggaaaagcatcatttcttttgctgttttgctaagggaatacatctggatctgagacagaaaatggaatttaatgtgattgagatgatcgtgtgtcattagcaccataggctatgaaaatattcccaagttgcagattcaatattcagcaagtgatttctgaagcacttactcttgccagatactaattattctaggctctgaagatacagcagtaaacaaagtgacaaacagctctactttcattgaccttagctggaggagacataggtcaatagataaataatttttaaaaatatctaatttcttcagatgtctatacgtagtactgaaaaatatgccaaagtgaagggtaaatgcatgaaatgcataatgtgtagagggtactgtgtttaattagcatggtcaggaaagtagagagaaaatgtttacacttatcattgcagcatctccttcctttgcttgtatgtaacactagacatgtgtccttttttcaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79362 - DNA, 4532 bp, Homo sapiens
  misc_feature (1043)..(1043): n is a, c, g, or t
  misc_feature (1140)..(1140): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacat

SEQ ID NO: 79363 - DNA, 4603 bp, Homo sapiens
  misc_feature (1043)..(1043): n is a, c, g, or t
  misc_feature (1140)..(1140): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtacatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79364 - DNA, 1897 bp, Homo sapiens
aacatggtcatttttattaaagtaaaaaataagatagtagtagctctggacatttggaaatgtgtatgtttgtttacaccctgtgaaaagtagacatggtctgcaaaagagccaatctcctaaatatatttctttctctagaaatgttattttgggacaaatgaatgaatccctgttgggaaaaaagaacctgctgcatatcatccatattttattttattattattttttttgagatggagtctcactctgtctcccaggctggagtggagtggcacaatctcggctcactgcaacttctgcctcctgggttcaagcgattctgctgcctcagcatgcccagtagctgggattacaggtgcatgccaccacacccggctaatttttgtatttttaccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79365 - DNA, 4105 bp, Homo sapiens
  misc_feature (1043)..(1043): n is a, c, g, or t
  misc_feature (1140)..(1140): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccacagccagccttggtctccttgcagtgcctacatgattacatcatttctggataatagtcatggggaatgtttgatggacaagcctcaagaatcccatacagctcccaagcgat

SEQ ID NO: 79366 - DNA, 3179 bp, Homo sapiens
  misc_feature (1043)..(1043): n is a, c, g, or t
  misc_feature (1140)..(1140): n is a, c, g, or t
gttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaagctccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtnggcggcacgtgcggggtcgtggacgacgagccccggccgactgggaaagcggagaccgaagacgaggacgaagggactgagggcgaggacgaagggnctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaa

SEQ ID NO: 79367 - DNA, 684 bp, Homo sapiens
ctcttgttgcccaggctggagtgcaatggcatgatctctgctcaccgcaacctccgcctcccgggttcaagcaattctcctacttcagcctcccgagtagctgggattacaggcatgtgccaccatgcctggctacttttctgtatttttagtagagacagagtttctccatgttggtcaggctggtcttgaactcacaacctccggtgatctgcctgcctcggcctcccatagtgctgggattacaggcatgagccaccatgcctgcccatgaaagcacttttaaaaagagagcacctctgctgcctggtcatattctgtacctgttcccaaaccctgaaaccagtgatgtcaatggctgcgtgggcattgaacgtgtacatgattcctgcagctttcctgttgagccagaccatgttcatcaatgctttttggtacattaattctacatcttcttcggtgaccacagtttatgtttatttcatttttcaggaatatccagccactggtgcacagccattgccacttgtgcccccaggggatcttgtcaactccagtatgtccccccagcactgtgttatctggcataataaatgtagttgggctgtagttgtagtgactcctcccaaaacaacccaggagtttaatactgtttggccaccggttacagacattgctgcccct

SEQ ID NO: 79368 - DNA, 1181 bp, Homo sapiens
  misc_feature (1065)..(1065): n is a, c, g, or t
  misc_feature (1069)..(1069): n is a, c, g, or t
  misc_feature (1072)..(1072): n is a, c, g, or t
  misc_feature (1105)..(1105): n is a, c, g, or t
aaccagcagccctaaaaaattaatcttcgtttggcttctaccaaaagtcatggtctacacaaagccctgcctactagaggcaataaggaaccatgaccaccacccccatttattcaaattacccactggaatgcaccgagtggggtttcaccctctgctgcttgtatgtttctcaacccatgttctaatcccatgcagtcatcattcaggaatccctgaggatcccctgattcaacttctcttttttgaatagattagaaattcctatcttctttcacttttactgtgacttttcagcttcctgttttccattcctgagggctatgaatcatatttccaaaataaatgatgatctatggagaggattttgcatttccaacatccttagctaattttaatgaattatcatggtcacatgatcctaaggcttcaggaatcggaggaagtggctgacactgacttaccattttaaccaaacaatcactgcacttaagcttggataagggtcaaataaaactaacagggctcttatgcaagcccttccagtctggtaagttatgagtatttatgttttatttccccccaaaaacaataagaccctcagaggcaaggaactcatcttggtttttgtcccttacacacctatctcagtccagtggtatgatgggcactggaaacaaaccacctggttcaaatcctggcttggtcacttattggccaagtggcctgatatggtttggctgtgtccccacccaaatctcatcttgaattgttagctcccataattcccatgtgttgtgggagggacctggtgggagagaattgaatcatgggggcggtttcccccatattgttctcgtggtagtgaatatgtctcacgagatctgagggttttataaggggtttctcctcttgcttggctctcattcttgttttgcctgccaccatgtaagatgtggctttgctcctccttgcctttgtcatgattgtgaggcctccccagccctccccaggtgacacattggaactgtgagtcaattaaacctttcctatataaattaaaanaaanaanaaaaaaaactcgagggggggcgccgtacccaantcggcctatagggagtcggactacaatttaattgcccgccgttttacaacggtctgactgggaggcggataacgat

SEQ ID NO: 79369 - DNA, 1127 bp, Homo sapiens
  misc_feature (1011)..(1011): n is a, c, g, or t
  misc_feature (1015)..(1015): n is a, c, g, or t
  misc_feature (1018)..(1018): n is a, c, g, or t
  misc_feature (1051)..(1051): n is a, c, g, or t
aaccagcagccctaaaaaattaatcttcgtttggcttctaccaaaagtcatggtctacacaaagccctgcctactagaggcaataaggaaccatgaccaccacccccatttattcaaattacccactggaatgcaccgagtggggtttcaccctctgctgcttgtatgtttctcaacccatgttctaatcccatgcagtcatcattcaggaatccctgaggatcccctgattcaacttctcttttttgaatagattagaaattcctatcttctttcacttttactgtgacttttcagcttcctgttttccattcctgagggctatgaatcatatttccaaaataaatgatgatctatggagaggattttgcatttccaacatccttagctaattttaatgaattatcatggtcacatgatcctaaggcttcaggaatcggaggaagtggctgacactgacttaccattttaaccaaacaatcactgcacttaagcttggataagggtcaaataaaactaacagggctcttatgcaagcccttccagtctggtaagttatgagtatttatgttttatttccccccacacctatctcagtccagtggtatgatgggcactggaaacaaaccacctggttcaaatcctggcttggtcacttattggccaagtggcctgatatggtttggctgtgtccccacccaaatctcatcttgaattgttagctcccataattcccatgtgttgtgggagggacctggtgggagagaattgaatcatgggggcggtttcccccatattgttctcgtggtagtgaatatgtctcacgagatctgagggttttataaggggtttctcctcttgcttggctctcattcttgttttgcctgccaccatgtaagatgtggctttgctcctccttgcctttgtcatgattgtgaggcctccccagccctccccaggtgacacattggaactgtgagtcaattaaacctttcctatataaattaaaanaaanaanaaaaaaaactcgagggggggcgccgtacccaantcggcctatagggagtcggactacaatttaattgcccgccgttttacaacggtctgactgggaggcggataacgat

SEQ ID NO: 79370 - DNA, 1016 bp, Homo sapiens
tgctgagtttatggtacacgcatattaactaagagaaagtgtcctatataggcagttagaaagtgagacactctagagagcttacagtactagatagaactttgtttagttttcggtggtagaaaatgaagctctctttctagaaaagaggagtcctgattcgtacatagcgtttttttcttctgatgaaaacaaatacataaacaagatgtgatttttgatatttttcagcacattttaacttaaaaattattttaaagaatttgtgtaagtaaaaatatgtgttaattatgagaacatcaaaactatagtgattaatgaacatttccatatagtaaattatggctgcaaatgaaggaagtcacagcccactgtttcatgtggcatctagtctcatacattcagagaataatactgaattctggttttgtattctaattagagcactaacaagatagtattcattagaagaagacaaagtgtctaaaaatcaggccatagaaagtacagctagattggaagaataaattctgttttatagaagtatagggtgactataattaacaacaatttattatatattttcaaatagctagaaaagagaatttagaatgtttccaacacaaagaaatgataaatgtttgaggtgatggatatgctactgatatgatcattacacattgtatacctgtgtcaaaatatcacactgtaatccataaatatgtatgattgttattaatatgtatcaacaaaaaataaaagaaaaaaattgccattcaaggtactaaaatttttaaaagaatgtcaattcaaatgggttattcacctttgaaaagaggtgactatagtttataataatatattatatatttcaaaatagctagaagacaataattggaatgtttttagcataaagaaaagacaaacatttaacatgatggatatcccaattacaccgatttgatctttacaaatcacatgaatgtatcaaattatcacatgtaccttccccttcc

SEQ ID NO: 79371 - DNA, 409 bp, Homo sapiens
gtgtgccaccacacccggttcatttttttgtatttttagtagagatggggtctcatgatgttgtcctgggtggtcttgaactcctgagctcaggtgatccacacttcggcctaccaaagtgctgggattacaggcgtgagccaccgcgcccggctaaaagaaaggagattctaatgcatgctacaacaccgatgaaccttgaggacatgacgttacgtgaaataagccaggaacaaaagacgaaggctatatgaatccactcatatgaagtacctcgattagccaaatccatacagaaagtagaacagtggttgccgcggggaggggaaatggaaagcctatatttaatgagtccagaagctttttttggtttgtttttagacggagtctcgctctgttgcccaggctg

SEQ ID NO: 79372 - DNA, 308 bp, Homo sapiens
aagatttttttgcccttggtaaaaagtctgctcatgattttatgaatagcataaaatgaggctagtggtgaaataccccaactttcgtgtagacagtaactttgaactttaaaacaaagagggagaaaagcattgaatatgctgactatgaactgtcctttatacacataaacacatgaatacaatagtgctaaggtgagcagtgcacagcatagctgttgggttatttttagaaatggcaaaaataaagccacatgcttttacccagtctctttgtgagacaaataatcagaaagcagtctgcgaaa

SEQ ID NO: 79373 - DNA, 339 bp, Homo sapiens
aagccaaagggatttgctgccatgctgtgacatggaaggcagggtgcactcagcactgtattgatgacgttcttaagtctgaaggacttaatgcagtttctggatgtgcctcctcatcaccacacctgttcaagggggaaactgggacccaccccaagagtcagctctatagaagtttttcctgacaatactctctactcctggaggtagactgtgtttttctcctgtactctcctctaacacagaacttgcgtgttactatatgcaacttgtttatctgccccctggactgtgaacccttgaggacagggatattgtcttatcactctttgaattctc

SEQ ID NO: 79374 - DNA, 1199 bp, Homo sapiens
tatatatttaagtagtttgctacatattgtattggatttatttcatgctaaaataattattttcttttttgtttacattgtccatgggaaaatgctaagtcacagatgaatacagcaagattaaatattgcagacctagggatccaaatgaagaactagatgttttagattttatgagattatatcagactatctaaaaagctacatttataaaaagtactggaatacagtaggcataaaacaaacttggtttctattgcatttattacaaattttagaacaaaaccatgtcctttgcagcaacatggatgcagctagaggtcatcctaagcaaattaatgcaggaacagaaaaccaaatattgcatgtcctcacttataagtgggagctaaacattgaatacacatagacaaaaatgggaacaacagacactggggaccactagacagaagggagaatgaggctatgggctgaaaaactaactgttgggtactatgctcatcacttgggtgacaggaccatccatatcccaaacctcagcatcatgcagtatacccaggtaacaactctacacctgtactctttcactaccccctcaaaaaacactggggagtacaatttgctggatcatatggtagaagtatgtttaattttgaaggaaactgccaaattattccaagtggctatactgctttgcatttgcaccaagcagtgaatgagagctcctattactccacatcctggccagcatttggtggtgtcagtattttggattatactattatgaagtggtatctcattttgatttccaattacctgatgacataaaatgttgaacattatgcttgtttgctatctgtatgtcttctctgataaggtgcctgtttataccattggcccattttaaaaatcttccttttgttgttgttttgttttcttattaagttttaagagtgctttgaatatttggaataacaatcttttgttaggtatgtctcttgcaaatattttctcccagtctgttgcttgtcttctcattctcttgacagtgtgttctgcagaggatatttatttttaaaaacaaaatcagggcacctctataagataatatagccacttcaaatgatactacagaatattagcatagacatgtactcacagtgtattttgaataaagcatgcaagtattttaaaaaaat

SEQ ID NO: 79375 - DNA, 433 bp, Homo sapiens
gtggagaagagataaggtgggactcgggaaggaaatcagtaatttggttttggccttgctaagtttgcaatctgagtatagatgtccagtaggcagttgaatacatgcatctggagttcctgggagaggtccaggctgaagatacaaatttggaagctgccagcctgtaaatggtgtgtaatggcatgggaatgaatgagatcatctagggagcaagtgtgggtaaacaaaggaagagtactaaagacaagcctggaaagctcccagcttttagagatttggttaaaagcaagaggcgctagcaaagaaaatgagcaatgagtgaggctggagtgaaatcagaggagtgtgggtccttgaaatgtagagtggagaaagaacttagtttggtgaactgtgatgaatctgtggcaggttaggttaaaaaaaaaaa

SEQ ID NO: 79376 - DNA, 489 bp, Homo sapiens
tggaaatatgcgtaaggtaagtggctgctgaagtgaagaaacatctaagtcagagtgaggggctcataataaggcacctaccttcattcttatcctcttattttcatgattgatctcccttggtggtcacctttcacttcgtggttcaaggtcctctattcttttctcactgctgtctcttcaagtatggatggaccagagatcattcaattatattaatcctcataatattcaatacattctttaggcacttggctcatgaaagtagatgtgttgttgtgaaaatattgtttcaacttgtattttattttagctgttgtttatttttcttctgtgaaagcccttggttaaaaaaaatagagtatcagagttgggagtacagggaagagagctgaagcagtgttaggtctgtcaaacataataataaaaggccagttaggtagtggtgactttgaaaataaacctcatctagccactgatcatcgggag

SEQ ID NO: 79377 - DNA, 480 bp, Homo sapiens
ttgctcctgctcttgtccaactcacaatcatcgctctcccgtacttgaacatctgagtcatgttcctctctacttcctacttcccatctccagccatttcccacatagcagccaagggatctgttaaagatctaagtcgggccaggtggggtgactcacacctgtaatctctgtgctttgggatggatcacctgaggtcaggagttcgagaccagcctggccaatatgatgaaactctgcctctactaaaaatacaaaatttaaccaggcgtggtggcaggtgcctgtaatcccagctactcaggaggctggggcaggagaatcacttgaacccaggaggcagaggttgtagtgagctgagatcgtgctactgcactctggtctgtgcaacagagcgagactccatctcaaaaaaaaaaagggagagagagaaaaggaagaatcggcatacctgtaaactcctccttctaaatgttccag

SEQ ID NO: 79378 - DNA, 470 bp, Homo sapiens
ctgtaccaattattaagcctttagcatgtaccaggtattgtgctaaggatttgatgtgtcttacttcatttaagccttttagcaaccccaggagaaaaaatacaggttgaccatttcttatctgaaaatctgaaattcaaaatgcccccaaatctgaaactttttgaataccaacatgacactcaaaggaagtgctcattggagtatttcagatttttggattagggatgcttaacagctaagtgtaatgcacatattccaaaatgttaaaaaaaaatccaaaatcctaagtacttctatcccaaatgtttgtttgattgattgatcgagacagggtctcactctgtaatcccagctactcaggaggctgaggcaggagaatcgcttgaacctgggaggcagaggttgtggtgagctgagatcatgccattgcactccagcctgggcaacaagagcaaaattccgtctca

SEQ ID NO: 79379 - DNA, 1082 bp, Homo sapiens
cccagccagcaggccactcagggcctacaggccgcatcttgcccacccaagagttccctgtctctgtccgctgggcacccagagctggggacctgggggtcaccctggattcttcactccctcttctttacgtctctccaaggcacgaacgtgtctccctcctgaagccaccgatgtggtccaggcctctgggattcctcaccatgacgacaggggtccagttccccaccccctacacccaaccactgccacagtgaccttcttataagcaaatgtgatcacaccctctccctgcttaaaaatcttcacagcccccagcccttcaaataaagcccaaattctccagcagggtatatgaattcctccccagtctgccccaatccacgtccctgcctcacccccaacccacgaagctcacgcagcctctgcagctcactcaaggccctcttgggccaccatgcttttgcatatgctgtccctggtcccggaagcaccctctgccagcctgcctcgagcacatgcctaattgcccttccatgctctgcctaagtgccgctcctctgggagtcctccccgcctggaatattgttggacgctcccctggtgtccccacagagtctgtatgtatctgtgccatgccagttcacagcaccccattgtaactgtatttgcgtgtctgtccccgttactccacccccatgtccctatgcccatgaggccccagagggccaggactgtggcttgttcatttgcactgtgcctggcactcagtagggactcagtgaatgaatgtggaatgtggttcacacagccagggagaatgggataccagccagggcaagaacagtctactgggtggggcaggatccaggacaaggaggtgagcagcccttcctccggccactcaagtagtggggactgggaggaggggcgctttgtctacgcagtcttcttatggctcatcaccgtacagacagggcacctgcctcctgccacgctgacttcaggactggtcgagccccagggaacatttgcagggcagcccaactttggccctggccctggcgctggccctggctctg

SEQ ID NO: 79380 - DNA, 86 bp, Homo sapiens
  misc_feature (41)..(41): n is a, c, g, or t
atgattctggggtctattactgtgccacctgggacaggcanaaattattataagaaactctttggcagtggaacaacacttgttgt

SEQ ID NO: 79381 - DNA, 382 bp, Homo sapiens
cctcctattaaaggtgagataaaccataccagagtgacagtacctcaaaaagaagaggtacaagattagtagaagttaacctggatacaagtactagtcagacgggatagagaagctaatggagaggtggaggaaacatatcatatgggaaatacaaaaacaggggaaaaagaaagtggtaacatatcagctattcttcaatttgccatagttcctgaaccttccaactgcttcactccctgctcatctgagcttcaacttcatctttctctcaaaagttcttctcctttagtgatctaagattcatgtttgtacctagtcctatcatctcctgatcctttttccctccgcttctaccctgtattctttaccagtttaaaga

SEQ ID NO: 79382 - DNA, 638 bp, Homo sapiens
caaagttcttccaacaatttaagccaggaattgccccactgtttccgaggtgatgagagcctctgagagatgagaaaactgaggcacatagggttaagtagattgtccaaggtcactgctgataactgcagcactgggatttgaagcactgaactctgctgactcctgagaagcatacctctaacagctgagatttccaaggctttttggccaatgtgtttgtcaacatctgcaacaaatttccagaactcaggccagagccctgggcaaagcctccttttttgtctcctctttttatctcccagtgcagtaggaagccatcagatgattttaaatggagaagtaagacacttggatctgtgcctaaaagaatcactctgctgttgagttcctgagaagcagactctgagatagagatcattttgtgggaagcttattgggaggtgctcttgggatccacacctgtagaagcctctttgctccccacacttcaggactggctctttaagatccaaaggagaagccaaccaaatgaaagcattcttggcaaccaggtattcctgaccagtccccggctctctgacaagctgtgtcacaatattgatccagtgattaaatttcatgctgaactgactcaa

SEQ ID NO: 79383 - DNA, 1008 bp, Homo sapiens
ctttccactggtttccaaattagatatgctagttatataaagttagtggttttctttcaggtttcataaggcttcatcttttaaacaaaaagcagcacttttgataactatttttagataattatatttctgattctcttgagatattttatctcaagagaaagatgttcatacctgcccaccaacttttataatagagcagatattttcgaaaagtcttatgttttcatctgagtatcagaatttttcctaaccagccacaacaataagatgcataacatgttttcctttgacaacacagctatacagttctgtgatctactcaaagccccttatattaatgcctttttccagaaatttactttcctggcacactagcatttaatcactaccgcataatgaactttacattgttttaagaactcagtgcaaatttaagcaacagtttttatatttggccattcaccacattctttctttcttctttggaaggatgttctcctcttgattgctactacaattattagtcaaaaatctcaaaattagattacttcatgtgtttaccaaccaacattctcttggattttctcaaccaccttcttcatccattttattcacagctaacagtaccatctaaatctaaactttcaaaaggtaagattttctcacggttctcactgcccacagaaacagctacaaaacctttcttttaccgggcatggtggctcatgcctgtaatcccagcactttgggaggacaaggcaggcagatcatgaggtcaggagttcaagaagagcctggccaacacggtgaaaccccatctctactaaaaatacaaaaattagctgggtgtggtggcgcactcccatagtcccagctacttgggaggctgaggcaggataattgcttgaacctgggaggcggagattgcagtgagccaagactgcaccattgcattacagcctgggcaacagagtgagactctgtctcaaaaaacaaaaaacaaaa

SEQ ID NO: 79384 - DNA, 327 bp, Homo sapiens
tataaaattatttttttcttaatttattgaaaaaaccatatggacagatgttatttgacggtgcttctcaaggtgttcatccacctgtgactcaagcttcctactgttgctccaagtcttggaaattgttttgggtttttgttgtcgttgtttttgttgaggcagtgtctcgctcttttgcctaggctggagtgcagtagtatgatttatggctcactgcagccttgacttcccaggctcaggtgatcctcccacctcagcctcccaagtagctgggactacaggcacatgtcaccatgtccagattttgtttttaatatttggcag

SEQ ID NO: 79385 - DNA, 372 bp, Homo sapiens
ggtattttttttggggggtcgggggcacagggtctcactatcacccaagctgaagtgcaatggcatgacatagctcacactgcagccttgaaccctgggatcaagtgatcctcccatcttagccccctgaatagctgggactataggtgagcaccaccacacccagctaatttttaaatttttgtgtagagatagggtctcgctacgttgcctaggctggtcttgaactcctgaactcaagcgctattcctcctaccttggctgcccaaagtgctgtgattatagccgttaaccaccatgccttactttttaagcacggctctacaaggctaaaatatattggagtgattttaaaccaccccctttgttttc

SEQ ID NO: 79386 - DNA, 3092 bp, Homo sapiens
gcgcgaggtggctcagccgcaagatggcggcgctggcggaggagcagacggaggtggcggtcaagctagagcctgagggaccgccaacgctgctacctccgcaggcgggggacggcgcaggcgagggtagcggcggcactaccaacaacggccccaacggcggcggcgggaacgttgcggcgtcgtcgtccactggcggggatggcgggacccccaagcccacggtggctgtctccgccgctgccccggcgggggcggccccggtgcccgccgctgctccggacgccggcgctccgcatgaccgacagactctactggccgtgctgcagttcctacggcagagcaaactccgcgaggccgaagaggcgctgcgccgtgaggccgggctgctggaggaggcagtggcgggcgccggagccccgggagaggtggacagcgccggcgctgaggtgaccagcgcgcttctcagccgggtgaccgcctcggcccctggccctgcggcccccgaccctccgggcactggcgcttcgggggccacggtcgtctcaggttcagcctcaggtcctgcggctccgggtaaagttggaagtgttgctgtggaagaccagccagatgtcagtgccgtgttgtcagcctacaaccaacaaggagatcccacaatgtatgaagaatactatagtggactgaaacacttcattgaatgttccctggactgccatcgggcagagttgtcccaacttttttatcctctgtttgtgcacatgtacttggagctagtctacaatcaacatgagaatgaagcaaagtcattctttgagaagttccatggagatcaggaatgttattaccaggatgacctacgagtattatctagtcttaccaaaaaggaacacatgaaagggaatgagaccatgttggattttcgaacaagtaaatttgttctgcgtatttcccgtgactcgtaccaactcttgaagaggcatcttcaggagaaacagaacaatcagatatggaacatagttcaggagcacctctacattgacatctttgatgggatgccgcgtagtaagcaacagatagatgcgatggtgggaagtttggcaggagaggctaaacgagaggcaaacaaatcaaaggtattttttggtttattaaaagaaccagaaattgaggtacctttggatgacgaggatgaagagggagaaaatgaagaaggaaaacctaaaaagaagaagcctaaaaaagatagtattggatccaaaagcaaaaaacaagatcccaatgctccacctcagaacagaatccctcttcctgagttgaaagattcagataagttggataagataatgaatatgaaagaaaccaccaaacgagtgcgccttgggccggactgcttaccctccatttgtttctatacatttctcaatgcttaccagggtctcactgcagtggatgtcactgatgattctagtctgattgctggaggttttgcagattcaactgtcagagtgtggtcggtaacacccaaaaagcttcgtagtgtcaaacaagcatcagatcttagtcttatagacaaagaatcagatgatgtcttagaaagaatcatggatgagaaaacagcaagtgagttgaagattttgtatggtcacagtgggcctgtctacggagccagcttcagtccggataggaactatctgctttcctcttcagaggacggaactgttagattgtggagccttcaaacatttacttgtttggtgggatataaaggacacaactatccagtatgggacacacaattttctccatatggatattattttgtgtcagggggccatgaccgagtagctcggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcatttctgttcaaatgctattttaatttattacatttagaaaaaaagttgatttcaataattcatcctgcttcaagattcaaattcagaaatatactatcatcttgaattttagctgaagaatcctatagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatcgacagcaacg

SEQ ID NO: 79387 - DNA, 2445 bp, Homo sapiens
gcgcgaggtggctcagccgcaagatggcggcgctggcggaggagcagacggaggtggcggtcaagctagagcctgagggaccgccaacgctgctacctccgcaggcgggggacggcgcaggcgagggtagcggcggcactaccaacaacggccccaacggcggcggcgggaacgttgcggcgtcgtcgtccactggcggggatggcgggacccccaagcccacggtggctgtctccgccgctgccccggcgggggcggccccggtgcccgccgctgctccggacgccggcgctccgcatgaccgacagactctactggccgtgctgcagttcctacggcagagcaaactccgcgaggccgaagaggcgctgcgccgtgaggccgggctgctggaggaggcagtggcgggcgccggagccccgggagaggtggacagcgccggcgctgaggtgaccagcgcgcttctcagccgggtgaccgcctcggcccctggccctgcggcccccgaccctccgggcactggcgcttcgggggccacggtcgtctcaggttcagcctcaggtcctgcggctccgggtaaagttggaagtgttgctgtggaagaccagccagatgtcagtgccgtgttgtcagcctacaaccaacaaggagatcccacaatgtatgaagaatactatagtggactgaaacacttcattgaatgttccctggactgccatcgggcagagttgtcccaacttttttatcctctgtttgtgcacatgtacttggagctagtctacaatcaacatgagaatgaagcaaagtcattctttgagaagttccatggagatcaggaatgttattaccaggatgacctacgagtattatctagtcttaccaaaaaggaacacatgaaagggaatgagaccatgttggattttcgaacaagtaaatttgttctgcgtatttcccgtgactcgtaccaactcttgaagaggcatcttcaggagaaacagaacaatcagatatggaacatagttcaggagcacctctacattgacatctttgatgggatgccgcgtagtaagcaacagatagatgcgatggtgggaagtttggcaggagaggctaaacgagaggcaaacaaatcaaaggtattttttggtttattaaaagaaccagaaattgaggtacctttggatgacgaggatgaagagggagaaaatgaagaaggaaaacctaaaaagaagaagcctaaaaaagatagtattggatccaaaagcaaaaaacaagatcccaatgctccacctcagaacagaatccctcttcctgagttgaaagattcagataagttggataagataatgaatatgaaagaaaccaccaaacgagtgcgccttgggccggactgcttaccctccatttgtttctatacatttctcaatgcttaccagggtctcactgcagtggatgtcactgatgattctagtctgattgctggaggttttgcagattcaactgtcagagtgtggtcggtaacacccaaaaagcttcgtagtgtcaaacaagcatcagatcttagtcttatagacaaagaatcagatgatgtcttagaaagaatcatggatgagaaaacagcaagtgagttgaagattttgtatggtcacagtgggcctgtctacggagccagcttcagtccggataggaactatctgctttcctcttcagaggacggaactgttagattgtggagccttcaaacatttacttgtttggtgggatataaaggacacaactatccagtatgggacacacaattttctccatatggatattattttgtgtcagggggccatgaccgagtagctcggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagacc

SEQ ID NO: 79388 - DNA, 3111 bp, Homo sapiens
gcgcgaggtggctcagccgcaagatggcggcgctggcggaggagcagacggaggtggcggtcaagctagagcctgagggaccgccaacgctgctacctccgcaggcgggggacggcgcaggcgagggtagcggcggcactaccaacaacggccccaacggcggcggcgggaacgttgcggcgtcgtcgtccactggcggggatggcgggacccccaagcccacggtggctgtctccgccgctgccccggcgggggcggccccggtgcccgccgctgctccggacgccggcgctccgcatgaccgacagactctactggccgtgctgcagttcctacggcagagcaaactccgcgaggccgaagaggcgctgcgccgtgaggccgggctgctggaggaggcagtggcgggcgccggagccccgggagaggtggacagcgccggcgctgaggtgaccagcgcgcttctcagccgggtgaccgcctcggcccctggccctgcggcccccgaccctccgggcactggcgcttcgggggccacggtcgtctcaggttcagcctcaggtcctgcggctccgggtaaaggtgagccgtggggtcccggttggaagtgttgctgtggaagaccagccagatgtcagtgccgtgttgtcagcctacaaccaacaaggagatcccacaatgtatgaagaatactatagtggactgaaacacttcattgaatgttccctggactgccatcgggcagagttgtcccaacttttttatcctctgtttgtgcacatgtacttggagctagtctacaatcaacatgagaatgaagcaaagtcattctttgagaagttccatggagatcaggaatgttattaccaggatgacctacgagtattatctagtcttaccaaaaaggaacacatgaaagggaatgagaccatgttggattttcgaacaagtaaatttgttctgcgtatttcccgtgactcgtaccaactcttgaagaggcatcttcaggagaaacagaacaatcagatatggaacatagttcaggagcacctctacattgacatctttgatgggatgccgcgtagtaagcaacagatagatgcgatggtgggaagtttggcaggagaggctaaacgagaggcaaacaaatcaaaggtattttttggtttattaaaagaaccagaaattgaggtacctttggatgacgaggatgaagagggagaaaatgaagaaggaaaacctaaaaagaagaagcctaaaaaagatagtattggatccaaaagcaaaaaacaagatcccaatgctccacctcagaacagaatccctcttcctgagttgaaagattcagataagttggataagataatgaatatgaaagaaaccaccaaacgagtgcgccttgggccggactgcttaccctccatttgtttctatacatttctcaatgcttaccagggtctcactgcagtggatgtcactgatgattctagtctgattgctggaggttttgcagattcaactgtcagagtgtggtcggtaacacccaaaaagcttcgtagtgtcaaacaagcatcagatcttagtcttatagacaaagaatcagatgatgtcttagaaagaatcatggatgagaaaacagcaagtgagttgaagattttgtatggtcacagtgggcctgtctacggagccagcttcagtccggataggaactatctgctttcctcttcagaggacggaactgttagattgtggagccttcaaacatttacttgtttggtgggatataaaggacacaactatccagtatgggacacacaattttctccatatggatattattttgtgtcagggggccatgaccgagtagctcggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcatttctgttcaaatgctattttaatttattacatttagaaaaaaagttgatttcaataattcatcctgcttcaagattcaaattcagaaatatactatcatcttgaattttagctgaagaatcctatagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatcgacagcaacg

SEQ ID NO: 79389 - DNA, 867 bp, Homo sapiens
ctcaaagattttttttttctccttaatttggcctcttttcctatctgtctttttacttatccactgttttcctttagtggtaaactgatacaactgttttcctattcaagcatagcctctttattttcctataatcccatgtataattttcataatttcctttcctcaaatctttaaaaaaatttggttaaattttcttctttctgtgtgagttacaagtgtttctgtgcttcctttccttaaaatggtaaaatatactactcaattcttaacctagcacttttatgttttctcagcattggctcagagctcccggtgcaggcaggttgtgaatcctgaggggaaagacagtgacagacagacagacatggacagacaagcgacatctgccttgccttttgtgaccaaacctcagaattcacagtgtcacttcctctatactctattaattgaggcagttacaaagtcccacccccggtcccactgagggagggaagcagccctctttaggtggaatgtcattgtccccctaagaagagcaggtgggatgggatgtagactggtgtggcccatctttgaaaaataacatccggcatgcctctcctccattttaaatatacatttggtcttcccaggaatagaactgtgtataatgcctatataaaacagaggtatacctgtatttcagtattaaagtgtgaattttaaaaaactaattaaatggattgttactgttggcacttctctttacaaatggcagtttcatgaaaatttaatattcagtttaatagccctgcaccagacaattatgacagttcttcaaaatctttttgtttatgggtttcacaatttaccttaaaaaaaaaa

SEQ ID NO: 79390 - DNA, 755 bp, Homo sapiens
tgtactcccacccattattagcagtttggtgggggtttccagattgttttctgggtacacattttctatgtgtgctctcatcggcatgtgtgtaacttctgaggcttcgtgcttagaaagactttccttaaaatggtaaaatatactactcaattcttaacctagcacttttatgttttctcagcattggctcagagctcccggtgcaggcaggttgtgaatcctgaggggaaagacagtgacagacagacagacatggacagacaagcgacatctgccttgccttttgtgaccaaacctcagaattcacagtgtcacttcctctatactctattaattgaggcagttacaaagtcccacccccggtcccactgagggagggaagcagccctctttaggtggaatgtcattgtccccctaagaagagcaggtgggatgggatgtagactggtgtggcccatctttgaaaaataacatccggcatgcctctcctccattttaaatatacatttggtcttcccaggaatagaactgtgtataatgcctatataaaacagaggtatacctgtatttcagtattaaagtgtgaattttaaaaaactaattaaatggattgttactgttggcacttctctttacaaatggcagtttcatgaaaatttaatattcagtttaatagccctgcaccagacaattatgacagttcttcaaaatctttttgtttatgggtttcacaatttaccttaaaaaaaaaa

SEQ ID NO: 79391 - DNA, 440 bp, Homo sapiens
gcgaagactttggcagagcgcacagcaggccaggagaggctggcgccccttctcccaagaatactgtcagatgctgatcctgacaccacctggaattccttctcccggaccttccttcgtgtcctctgggcccgggcccagttgtccccactcagtgtggccctgttcttcgcctgccttcgcgacagtgcggtgggaccgccgtcggcccgggcctcccctgccacccagcggccacctcgggcacaggagaggggcatagcggcttcaagtaggggtagcccggaggcccggagctttggaggagcaccctttgagtccagaaactttttaacttgtcctctatgccagcatgttcagcaaacgtcttgttgttattgttgtcgttgttgttgttgtaaggggaggaataaaccttccacttatccgcctccaaatgg

SEQ ID NO: 79392 - DNA, 342 bp, Homo sapiens
cctggcttcatacagaatgtgacaagggcataagcccaggtcctgctgcctccctttcacacaatgcccaacttattgtcttcctcgtgtcatcaaaacctgcccattccctgacccaaccagaagctttctgtcctaatcatataccagaggacagacaatgtgatttgctttttccaaatctcagtggctgattctgaacaactgtggtctcttttatcttaagggtctcttttaactgctagagctctccatttctcctcctaaaagagaaggatttcttttcttttaagtctcctatttcttcacacagttcaaggaaatgagcaataaatgttttaa

SEQ ID NO: 79393 - DNA, 538 bp, Homo sapiens
cacgtgtgcaactctggggtgaaagacaccagcttcttctgcagattacctgtatcatttgggtttgaagcatattctgatgtgtctttgtgaataccagtttattctcaaggattttaggttgtcttttcttttctttttttttttttttctatttcgtttagagcttttcttcctgatggcttatctaccgatcaaagcaacttctacctcaccagcagatacagaggcaacttcttccatagatttcttcaccagttttccttagctgtctccttggtaagtgacttttctctgatgcttcaaccgtctcctggaactttacttcacccactttccccagaattttgtaaggcataaatccttataatgtgttttattttatatcactcacagttgttctggttccatgattgaatcctaacctatacttatggtaaataatttaaagtgttcatctagcaactataaatagatggtgtgtctagaggagaggatgaatgtggggagtagcagaaaataaagccagaaagaaacc

SEQ ID NO: 79394 - DNA, 867 bp, Homo sapiens
gaagaggcaagatttcagggaaaaaataggtaaaaagatgtttagagcaagaggctattgcagttttatgtgaagggcaatgagtagacattcctcttgatgagatcggcacctaaaactgtgtgggtgctaaagccactaaatcaagggttaaaaacttaggaaatctcagttcaagtagaagaataagtcttcttcttccttccaattcttgtatcttccctcatcagttctgccctccctccttcccttacactttgccttcctcctttccttcttttcttccttcttcccttcctttcttcttttctatccttccaagtatgtactaaacctctatttgccacaagtctttgtaattgagcaaagcaatgcagcccatggtacatgttcttcaaagaacttataaaccagttgatgagacatgacagaaacatgaaaaaataaaacaaccaagacatattatgatgcagtataataatggctgtaagttttcaggagagtgaaatcaatgcgagttagcatagttaaaaaaatacgtgatgttcaagttgtcaataaattgaatggagcaatttgaataagaattagggagttggggcaaaagatatttctgggaggaagcggcatcagcaaagatatgacgatgggaatatatgtggcaggttttaggaaagcacattagatcagtccagttatagatgaacattcaaataaagaaaagggcttaggttttaaagttagaaatgaaaataagttttgatagctaggatggcgacagataatatgaaatgtgggcctatatttagtatacaatcactaataaaacctctagtagcacttgagagtttacaaaagcttgttccc

SEQ ID NO: 79395 - DNA, 924 bp, Homo sapiens
taggagatatgcctaatgttaaatgacgagttaattggtccagcacaccaacaaggcacatgtatacatatgtaacaaacctgcacattgtgcacatgtaccctaaaacttaaagtataatataaataaataaataaataaaatgatgcaataattaaataaaaatacagtataaagttgctggttaaatgatgaaagaatagtttctgaactgcacatgtgatttctgtagaaaaatttgtattactcgtttattgcttatttcttgaacaggagtagatatttagaattactgtttgtaactaaggtgttcctcacaatccaagccagaactgcgtctcgaatgtatttcccaccatttctctgagctccagccctctccaaatcctactctttatcagtgcagcttctcaccattgctcagtcacacaggattgggggagagaagagggcagaaggggtggctttgcacctccccattgggcaggcctttcctctgcctgaactgtgctttgctagttctctacctaacaatttcctactcattctttaattcgctaaaatggtgcctttgagctgtctccagctgccccacccagcttcccctggctccctccgtggtgccctcacaaactgtttacaaatttccaacatagcaattattgcacactgtgagctcttccctttgtgttccctatgcttactatagccatgttgctgcctaagggacacacgtagggaaataagactcagcaacacatcccattcaacaacagccagcataagaaatggtaagcttttaagccaggtgcagtggctcctgcctgtagtcgcagctacttgggaggctgaggtgagagaattgcttgagcccaggggtttgagcctagcctgggcaacataatgagaccctggctctttaaa

SEQ ID NO: 79396 - DNA, 211 bp, Homo sapiens
gtcgacaaatgattgggttgctgcccatactgaatgggaaaagtccaaaggggatattctggcaacaaaaagaaggcagcaacctagaaaaaaaaaatcaacaggtaaactaaaaagaatctctaagaaaacaagtcaagtaaaaaacaaaacaagccagacagggaagattggaataaataacctttcaatgcaaagacatagaaagaca

SEQ ID NO: 79397 - DNA, 255 bp, Homo sapiens
ttaagtcttctattcaagtcactaaactttatattcatataaggtttaatccacagcatgtcatgatgctggcctttgataacttttttcaagagtccttggacagatgactgtgaccattgtggccatattcttacctaatccacacattggagaacgtgtttatcaagtttatgagttatatttccactaatcttcgtaaaagtaattatcttgcttattattacatgaaataaatgttgcacgtgaacaagc

SEQ ID NO: 79398 - DNA, 3854 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataataaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79399 - DNA, 3995 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79400 - DNA, 4665 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctccctacgcatgtttgagttgaatatcattgaagttcttaatgctgactctactattgggttgttaatagtcttctcttgacatgactctttatgcaacataacatacatttggtattcttcagggtttaaaagaaaacactgagctgtttcctccaagttttattaaccttttatttaacttactgctttatttttttctcttttaatatggttattgttaaaatgagagtcacttgctagactggtctctttaaatgtaaggtctagtatcaatatttacttcattcaagtggaataaatggctttttgtagttacttccagttttcctcaagaatagaaataagtctgttcataagcaataccttcagttttgttcagttcacttccacgttaaataaagaataggattattcactggtaataatagagtcattaagaaatattaagcattgcagctaaaaattgaacaaccctgtaatgatacatttaagaattattcaaaggtgctacatggcagggttagagaataaaaagaacgtggtgtttgaagcaaaacagatctgtattggcatcttggttctaccttttatcagatgttgttgccttgtgcaaatcacattttctctgagtctccattttctcatttataacatgcggagaataatacttatatttgtggtagtagtgtgaacattaaaaagataatgtatgtgaagtaccattcgagtggtgaatacgtttttatgagaatgtcatactgaaaaaatattgcaaatattaaagttttaggtaagcctaaactttaatctactttaattaaatgaattgattgactcaaccattcaga

SEQ ID NO: 79401 - DNA, 4296 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctccctaaaaaaaaaaaaaaaaaaaaaaaaaaaaaaaaaaaaaaaaacaaaaaaaaaaaaaaaaaacaacacaaaaacagcccaaaaaaacaaaaacaaatcaaaaaaaaaaaaaaaaaaactaggaacagacttcaaaataaaaaaagctaagagacacacgagaaacagttagatatactaaacaaccagcacagacaagaaccgcaaagactgtcactacatagaacacatctacgagaggaacaccaaaatcaaccgagaacagaccacacagcatccgaccaacgctcacctcgacaacagaaataaccaatcgaaagccacaacacatacaccaagcacaagaacagtcacctcccacacagaaccacatacacctagcacgacaacacataacactcgacatgagaacaaacacatcttcccaaggatacacaaaacaaaaaacataaaaaacaaacaaaacacatacaaaacag

SEQ ID NO: 79402 - DNA, 3047 bp, Homo sapiens
ccagctcagggaaatgctgctcagtttgggcttggatggtaacgtttattttccttggcagagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79403 - DNA, 3957 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79404 - DNA, 3860 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79405 - DNA, 3900 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatatagtgagcaaatactgtcatatagttcatttcatcattttctgttgcaggaagccactgcaaccacagaatgctaatatgtccagtggtaccctatgtacctcttgtatataggagcaaatactgtcatatagttcatttctatcattttctgttgcaggaagccactgcaccacagaatgctaatatgccagtggtacccagtacctcttgtatataggagaaaatactgctcatatagtgcatttcatcattttcctgttc

SEQ ID NO: 79406 - DNA, 1938 bp, Homo sapiens
gggttaataggtatgaaaagagaggggagaatgtgatattgactcttggtttctttccacacagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79407 - DNA, 1629 bp, Homo sapiens
attcctggactacggcgcgggagagggggtaggagggcccttgaagggtgcgcgttcccgtggcggtgcaccgggtaggtttcagtcagagtcactatggcggccggcgctggcaaggtcggaaagtttcctgcctcgtcgggcgcagcttgagcttgccccatcggccgcgatcggtggaggctgcggcggatccagcccggggcctcaaggcctctccccaacctccgggccagtctccctcccccaccttctcgtccgccgggagctgcggctgccgtccctgagatgcgaccctcgcgggggcgaccctgaggggaggcggcccatgtgctgagcggcggcccagaagcctaggcgtccggggaccaacttcctgccgcctgggaactcgagcctcccggtgtcgcgcctcgctcggtccgcaccggcctgcggagccgggtccccgccctggtcgcggggacgctcgccaggtgcccaggagtcccgacttggccactgcccgcgccccgccggcctccacgcctcgcgcggagaacctcagccaccgccgtctcggatcgtgccaggccggggaccgcgtcccccttcccggggcggcctccgctcagcaggggcgatgcagactgtcccgccggccgtctagagcccctccgtctccgtcacctctcgccccttcactccgggcgaggactggcggtggctgcccagaggtgcccagccacaccttccttcggcccaaaaggactttcctggccgcgccgaaccgacccttcattcatgctgcagtgctgcaacgtttccgccaccaagggggaaaagcggccgcgatctcaaaccaaacacaagaattggcgtgtgactcatctgcttggatacctccagtccccaaactgtgttccaggagttttcttggccgaagctgcccgatgtttgagccttttcttcccagagaagaagatggactgaaagctgccagttggggactttttgtgatcacggcgttgcagcgttttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccgg

SEQ ID NO: 79408 - DNA, 1926 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaagtatgcaagaactactctgtttttcagatataaatattttacaggagcaaatgttcagcccatctctgtttggctatttggcaggttaaccatactgaataaatacttcagcttttttttttcctgccaccaccattatcctacatgtcctttccttgtactcatggaatacagattcattaaatgtcccaaagaaaccctg

SEQ ID NO: 79409 - DNA, 1691 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaaggtactttaacatgtttttatgacatcgtaaaccagggtatcaaatcaccctttgccataaaatctgttctagatattatgtgaagttttaatttttagttaagagattaagataggttctgtaaagtagcagggactaaaaatttaaagttttggtgtttatacccaatatttcaaactattgttgaataatttggatcagtcaagattacgagggacaaagtgttaagtggtagaatatgaaatgcagctgtgttttttgtttacccttgtgtctctaataggaatttattagcgcttttaacataattagaataaggtgaaaatcttaactttcttgaaagactcaccggtttactctgttatcatatggtagcagttgtaaatttccttattttctggtcttcttcatcttctaataaatatccccaggttcttatgacactcttctagaaattttgggctaagaaactttaggtggatggccaggcatggtggctcacgcctgtaatctcagcactttgggaggctgaggcaggtggatcatctgaggtcaggagtttgagaccagcctgaccaacatggagaaaccctgtctctactaa

SEQ ID NO: 79410 - DNA, 385 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacagatagagtaactgagaggcaggaagatttaataatttatacagtatcacatatcaagtatatggtagagctgggatttgaacctggacagccagacctcagattttctgctttgtgtaactactgtgctgtgctgctggattcacagaataatttcttggtgtagagcagatactgcttcaagttaatgccatatttaaagaaccgtataaatctttaaaaagcaaacaa

SEQ ID NO: 79411 - DNA, 430 bp, Homo sapiens
gggctggcgggggtctggctggagggggcgacggctgaggcgggcgggctgaggcgcctgacggccgtttgttttgatgttttccccaccaggtcggaaagtttcctgcctcgtcgggcgcagcttgagcttgccccatcggccgcgatcggtggaggctgcggcggatccagcccggggcctcaaggcctctccccaacctccgggccagtctccctcccccaccttctcgtccgccgggagctgcggctgccgtccctgagatgcgaccctcgcgggggcgaccctgaggggaggcggcccatgtgctgagcggcggcccagaagcctaggcgtccggggaccaacttcctgccgcctgggaactcgagcctcccggtgtcgcgcctcgctcggtccgcaccggcctgcggagccgggtccccgccct

SEQ ID NO: 79412 - DNA, 3821 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79413 - DNA, 3944 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79414 - DNA, 3872 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79415 - DNA, 2796 bp, Homo sapiens
aacccaggttatgcattagctacaatcctgtatggattattcttttattctaatgggccaagaaaatgatggatatacttttgcagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatctattttgtaaagatataaagtacaatagaatttctggagtacagattaaactatttgcactaacacacgtgacgtgcatgatttaataaaataactttactctcccta

SEQ ID NO: 79416 - DNA, 3742 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaagaaaccctggccctggatgcccatgttggctgccctggttgcagtaacagccatcgtgctgtacgtgccaggtctggccagagcttctccatgagagcgttccttgagtccgtacaccgtcctccctctagaagctggcatcacactcatgctggggacaaacagaaccattttcttcctctttacctcttaaaacagcagaagtacaagaatacagctgtagggtcattgctttaaattatataaaatgtatctgtctataaagaagatataaaattgtgactttattctactgtaagcaataatttgcttgcaatttttcatgtaatttttaaattagtatgttaagattctgaatattatggtggcctaaagtaggcttcttggtacaccagattatttataacattaaatttatgagtattttactctgaattctgatcaccagataattcatttttctgatttgataactacccaaaccaaacaaccaatacatacatgggaagagaggccctgtgtgctcagtgcctatcagtttgaaatatatacacatatatatattttttacatatttacgccatttttacttgttatgaaaccactgagctattgggaacaagacttagagacaactatttgcgtggattttttttttttttaaggaaaaatacgtttggaaaataaactgttatggtgataatttggggaatatgtgcacgcttgttcagccttaatgtgacttgaagatgtggaggacatcaactttgaaaaactttccatgagagtgtattttcttgagcaaactgaagtatttctgggagcaaaaacatagtaattacacaatttcagtgcagtcaaccaaaatgttgagtcaattggaatgtaatttattaaaccatgtatttaaagagatatttttctttaaaagccaagttactttctcatatacagcattttaggaagcatgattttttttttctatcatctattcctccaagcatgtttaattgaagaaagtattaatatctctttagataagcttgtattgacctaatttggtttatgatgtgtcagagctaattcatgttcagggtgagcgttgtacctaccaacaaatttcctggttgggtatgcaaatggttattttctttttattgttgttaattgggactttctgttaatgaaaagcactattcccaagattaatagtgttctatgcacaatgaagcacctaaaaacactgcttgatattataaatttaaaacacaagtgaaagtttagccatggttttgtgcggcatcatagttatgtcaataaagtttatttaggtcatagaatatcctaaagtatcacatagttaaatttttcagtcagtgaagaccgggagggaatgtcagtgaattggcttgaatgttctgtggcaatccacaggtctagccaaatattgaaataggagtttagggtataatttgccttgtgatgtttggcagtcactgtttatactttaaaggttatattttaagctatttgagattgcttttgggaagatcactagatttatggaggaattagtcacaaatgacttgtagaaaatactgtcatatagttcatttcatcattttctgttgcaggaagccactccaccacagaatgctaatatgccagtggtacccagtacctcttgtatataggttattgcaaatattgttctgaaatgcttaacttcagaattacattttttaaagtaaataattgttttaaatgtcgacgcggccgcgaatttagtagtagta

SEQ ID NO: 79417 - DNA, 2237 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcaactgtcccgccggccgtctagagcccctccgtctccgtcacctctcgccccttcactccgggcgaggactggcggtggctgcccagaggtgcccagccacaccttccttcggcccaaaaggactttcctggccgcgccgaaccgacccttcattcatgctgcagtgctgcaacgtttccgccaccaagggggaaaagcggccgcgatctcaaaccaaacacaagaattggcgtgtgactcatctgcttggatacctccagtccccaaactgtgttccaggagttttcttggccgaagctgcccgatgtttgagccttttcttcccagagaagaagatggactgaaagctgccagttggggactttttgtgatcacggcgttgcagcgttttaaaggaggtgatggggcttgcgctggcttgtcttcccacccaagtgaagagttgatgttcactggttatgcttagacaatgtgcagtttgtgttaatttaaaattttgggtgggataggggcataggcttgtgaagggcagtccggatccggaggaactcctctttgtccctggtaggagagacacccccagtctatcctcgatgccgtcagccttggccatcttcacttgccgcccgaactcgcacccgtttcaggagcgtcatgtctacctggacgagcccatcaaaatcggccgctcagtggcccgctgtcgaccagcgcagaataatgccacttttgattgcaaagtgctatcaaggaaccacgctctcgtctggtttgatcacaagacgggcaagttttatcttcaagacactaaaagtagtaatggtacttttataaatagccagagattgagtcgaggctctgaagaaagtccaccatgtgaaattctttccggtgacattatccagtttggagtagacgtgacagagaatacacggaaagttacccatgggtgtattgtttccacaataaaactttttctaccagatggtatggaagcccgg

SEQ ID NO: 79418 - DNA, 2729 bp, Homo sapiens
gtttccacaataaaactttttctaccagatggtatggaagcccggctccgctcagatgtcatccatgcaccattaccaagtcctgttgacaaagttgctgctaacactccaagtatgtactctcaggaactattccagctttctcagtatctacaggaggccttacatcgggaacaaatgttggaacagaagttagccacgcttcagcggctactagccatcacccaagaggcttcagataccagttggcaggctttaatagatgaagatagactcttatcacggttagaagttatgggaaaccaattacaggcatgctccaaaaatcaaacagaagatagtttacgaaaggaacttatagcattacaagaggataaacataactatgagacaacagccaaagagtccctgaggcgggttcttcaggagaaaattgaagtggttagaaaactttcagaagttgagcgaagtctgagtaatactgaagatgaatgtacccatctgaaagaaatgaatgaaaggactcaggaagaattaagagaattagccaacaaatataatggagcagttaatgagattaaagatttatctgataaattaaaggtagcagagggaaaacaagaggaaatccaacagaagggacaggctgagaaaaaagaattacaacataaaatagatgaaatggaagaaaaagaacaggagctccaggcaaaaatagaagctttgcaagctgataatgatttcaccaatgaaaggctaacagctttacaagtacggttagaacatcttcaggagaaaactcttaaagaatgcagcagcttggagcacttgctttcaaagagtggcggggactgcacttttattcatcaattcatagaatgccagaagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagacgcccaaatggatgagcaagacctaaatgagcctcttgccaaagtgtcccttttaaaagatgacttgcagggtgcacagtcagaaattgaggcaaagcaagaaatacagcatcttcgaaaggaattgatcgaagcccaggagctagctagaacaagtaaacaaaaatgctttgaacttcaagctcttttggaagaagaaagaaaagcctatcgaaatcaagttgaggaatccactaaacaaatacaggttcttcaagcccaattgcagaggttacacatcgatactgagaatctccgggaggagaaggacagtgaaatcacaagtactagagatgaattgcttagtgcccgagatgaaattttgctccttcatcaagcagcagcaaaggttgcctctgagcgggacactgacattgcttctttacaagaagagcttaagaaggtgagagctgagcttgagcggtggcggaaagcagcgtctgaatatgagaaagaaatcacaagtctgcaaaacagttttcagcttagatgtcaacagtgtgaggaccagcagagagaagaagcaacaaggttgcaaggtgaactagagaagttgagaaaggaatggaatgcattggaaaccgaatgccattctctaaaaagggaaaatgttttgctatcatcagaactgcaacggcaagaaaaagaattgcacaattctcagaagcagagtttagagcttaccagtgatctcagcatccttcaaatgtctaggaaagaacttgagaatcaagtgggatccttgaaagaacagcatcttcgggattcagctgatttaaaaactcttctcagtaaggcagaaaaccaagcaaaggatgtgcagaaagagtatgaaaagacacagactgtactctcagaactgaagttgaagtttgaaatgactgagcaggaaaagcagtcaatcacagatgagctcaaacagtgtaaaaacaacctgaagctgctccgagagaaaggaaataatccttccatattacaacccgtcccagccgtattcatcggcctattcctggctttcctgttttggtgtttcggtccattgtggtagagaaaggtacaagcactattgttgagtccttgtctgtttgtccccgtcacctttttgtgccatatttgtaatatagtgcatggcaagaacacacaggtattttgttacctgaagcaaacccttcatttagtatgccgtgtatttgtgtcataccaatgaactgaacagtcaactaatcccataactttttgtcttgtttactttgtagtaatgctaaccatgagttaattccaacctaaccagttgttaatatgcttccattaactgagtctttatctctagcaaactggagtgcactatgaatttctgcaatattagtaccctctttccaattatgtgtttaatcagatttgaatgagaaatgaagagtttgcctccttgaagttttcagccagccttcttccccttcctccttatcctcttccttttcatagtgtagattttctttgtttcaaccctttgcctgtttatactatggctatgaagatgaaaaataatgagattaacataatgaaccattggctcacaatctcaaccctattgtgtacttgcaaggatataaatgtatcccatttctttctgagccctgacttgcaaccatcagaatatttctt

SEQ ID NO: 79419 - DNA, 3308 bp, Homo sapiens
aggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 79420 - DNA, 901 bp, Homo sapiens
  misc_feature (833)..(833): n is a, c, g, or t
  misc_feature (885)..(885): n is a, c, g, or t
  misc_feature (897)..(897): n is a, c, g, or t
  misc_feature (901)..(901): n is a, c, g, or t
aggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaagggaaatgttntttttacccccgggaaaggaaaaaaactggcttggggaaaaccttggggggnaaaacttggaanaacn

SEQ ID NO: 79421 - DNA, 3253 bp, Homo sapiens
aggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaataggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 79422 - DNA, 679 bp, Homo sapiens
aggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggcggggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacgg

SEQ ID NO: 79423 - DNA, 3255 bp, Homo sapiens
aggcatgcgcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 79424 - DNA, 278 bp, Homo sapiens
gcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttga

SEQ ID NO: 79425 - DNA, 368 bp, Homo sapiens
cagccctgcccagcatttgatggtgctatttttaatctttgatttttacaggtaaaaataatttatataatacatatgtatatatgcatgaaagaaagtctggaagtctaaaaaaccaaaatgggaatggtggtattatagacaatcttgttttctgtgtttaaatttgtatttgcgtatttatgggattgaacctactttaatgtctattcattacttatatttatgttgtgaattgcctcttgatagcctttatatataagtgctttctttatattaaagatgttaacccttgtgtattcattccttcagtgtgtaattttgactgagtgcctactgtgtgccacacacttttccaggtggttagg

SEQ ID NO: 79426 - DNA, 420 bp, Homo sapiens
aaatctcttatgggccaggcacagtggctcctgcctgtaatatcctagcactttgggagactgaggcaggcagatcgcttgagcccaggagtttgagaccagcccgggcagcaaagtaagaatgctatgaaaatatgatcataagttcaaaaagaaaacatcctcaaagaatgtgagcatggtttgggggcaatgaacacaatcctctctgagaaaaagctgaatggatccctgcagcacgtctgcagctgatctacaaatgctgggagcagttataggaggggatcttcaagttcacaatgcaactagaagaggcccaggtttgcaatcccaagacccacagaatctatttatttcagtgacgacaaaagctacttaaatcaacaatctgaggggaaacaaacagtaaagatacacaag

SEQ ID NO: 79427 - DNA, 480 bp, Homo sapiens
gacctgttgcccaggctggagtgcagcggctcaatctcggctcactgcaagctccgcctcctgggctcaagcgatctgcctgcctcagtctcccaaagtgctaggatattacaggcaggagccactgtgcctggcccataagagatttttttatttcagagaaataaggtacaaagtaagaatgctatgaaaatatgatcataagttcaaaaagaaaacatcctcaaagaatgtgagcatggtttgggggcaatgaacacaatcctctctgagaaaaagctgaatggatccctgcagcacgtctgcagctgatctacaaatgctgggagcagttataggaggggatcttcaagttcacaatgcaactagaagaggcccaggtttgcaatcccaagacccacagaatctatttatttcagtgacgacaaaagctacttaaatcaacaatctgaggggaaacaaacagtaaagatacacaag

SEQ ID NO: 79428 - DNA, 365 bp, Homo sapiens
cggaaaagaactagaagaaaatttagaacatacagattttctatataaagaaaatttattttgtatataaagttggggatggctaaaacttttctaagattgacaacaaaactagaaaccttaaagaataatatggataaatttgactttattaaaatacacacacacacacatcgtattaaaccttcctgtaagaaaaagaaaaagactgcaaacaaaattgaatgacaaatgacaaacagaaaaatatctataattgggaggccgaggcgggaggatttcttgagcctaggagtttgaggttttagtgagctgtgatcgcgccactgcgttccagcctgggtgacagagcaagaccctttctc

SEQ ID NO: 79429 - DNA, 203 bp, Homo sapiens
tgcccctttttgcctgattttcttctagagaaatcagagtccccacctctcacttgctggaccttccttagccagttaccactccttacctgccagtgctccaggccagctgcctcagcccttcactgccctcctccagccccaccactgctcattgctctctgcagcaggccttgcctcctaacactcaggagaaaaactct

SEQ ID NO: 79430 - DNA, 474 bp, Homo sapiens
ctacacaacggtgaaccattctatggaactggtctggggagatatctgactttagaaagaaaacttgatgggatggctgtggaatcagagtaagggtttagtttttctttggggaaagagagcgggattggagatttctgagtgtcaggaaggaagaagtaatttttgtatatttaaagctaagatggccgggcgcggtggctcaggcctgtaatcccagcactttgggaggctaaggcgggtggatcacctgaggtcaggagttcgagaccaacctggccaacatggcaaaaccccctctttacttaaaaaacacaaaaattagccaggcatggtggtgcgcacctgtagtcccagctattttgaaggcagaggcaggagaattgcttcaactcgggaggcagaggttgcagtgagccgagatcaccccattgcactccagcctggttgacagagcgagactcggtctcaaaa

SEQ ID NO: 79431 - DNA, 523 bp, Homo sapiens
aacgcagtttcttaaacaaatgcagcattttccaatagtttcgactaaagagaatgcagtaggaaacaactgtttacagaggcaaaaataagtaaatgtatattaaatgtatgtattatgtatcaacagacaaacatgtcacagggaagttcagacacctattctaacgtgtccaccctgaagtacttcttccatccagaaacaccacttttttcagtttaattcacctgcaatagagactcaagtaactgaatctacttccaccccaagattacacacagcaggtaattcagtatcaatgttcaacagaaacttgccctaaaggagacaggcagaagagccgtccagccccagccctttctctggagaaagtcggtcagccaagctcagtgagtgaagagtttgtttcagtacttggctcccaccttgggtttttcctttttgtctctgttctctgacttgggagttttgtgggacaggagagtctgaatttctttccagtcttggtctagcttctccgtga

SEQ ID NO: 79432 - DNA, 838 bp, Homo sapiens
tgaagaccttatttcccaggcttcatatgtgcagattagcagtggttcttgtttagcattgggctaaaataatgtacagtgaagtcaggtttggctaatatgacacaaaaatgtagagttttccctgcaaatgctatacataattgaatcactgaattacttagggggttatagtcattaccacacatctccaatttgttttctggaatctctgaagccacttattacaaatagacatttagttcctaatgatttcattgggggctgctacaatttttcatttgtagctttttcacctattgctacctaatacctttctctctctctctctctctctctctctctctctctcgtacctcttatttgatattgtgtttccagaattaattaatttagatgactttcacgtagtaacttttatccacaagtaatactttaagcagaaatatataacttggtttttctaaaataattaatttaacatatcaagaatggtattaagaaaaatatttggggatttttaaatgaaatttaaagtggaaatgtattacttgaggtagaaaaaccaattctatacatattcttaatagttaaatctcctagctcactgaagtttaaatttttggtatctcaattattcagaaaactgctgagattttggatgtaattgaaaatgctactgaattgagatcaaaagggataagtaagttatattcagaatagtgtcactggagatgcctctgagccaccaaaattaccatcataatgattatttaacttttgagaagtactcttggcttttggactcttaccttacataattttctgtcagtcttta

SEQ ID NO: 79433 - DNA, 477 bp, Homo sapiens
ggggagaatcacttcccgcacatttgggctgtgggcagaattcaattccttgtggttgtaggacggaggttgccattttcctgctggatgagggccattcccagcttctagaagccatctgcatgccttggtttgaggacccttcgactatcttcaaaaccagcaagggtaggtcagacccttctcacaggctcttcttccttcctttttatggactcatctcattaggtttgcagccacttgaataatcccagatcatttctctattttaaggtcagctgatcaggtcaactgaattctacctataaccttaattattttttgccatgtacggtaacgtatgcatagattctggggattagtatggagacatactaattacactgtagctagatatttgtgtcggagggggggcattattctgtacctagaagagaggggatttgtggggctgcagggtgtgtacatgttcagtgt

SEQ ID NO: 79434 - DNA, 357 bp, Homo sapiens
ttcacaggtcataaaatacaggagggactggctcagcgagcagcggatatgtgggcaaattctccacataatcagattacacaatgcaataaccaaccaaaacaaacatcgagataaattcatcacatcgactcaaatatgccactgtttataaagcattacacagtgtccaaggcaaatcacatacaacaaatggtaggtactgttgtcattattgttattaattccagaaaaatatttaaaatatgtagaactgcctgggcacagtggctcaggcctgtaatcccagcactttgggaggccgaggcaggcggatcacttgaggtcaggagttcgagaccagcctggccaacgtgg

SEQ ID NO: 79435 - DNA, 90 bp, Homo sapiens
cggatcctaggggcgcggggctggccccgctccccgctggcctcgcggcaactgggcctccccctcgctgcacgcagccctccaagctcc

SEQ ID NO: 79436 - DNA, 801 bp, Homo sapiens
gtgactcctaagctcagcgtggaagcttttccctgtcctgacccgatggagcagccggtaagtgaagagcacagctggaagcagagacaccttatgactcaaactgggcaaacaatcggaacgtcatgcagaaggaatggcctgactcctgcagtgcagattggaggccccagaactcctatgaactactgagagtctactggtttttaacttgttcctctgtctactgtgtgtttgggggtgacatctaaattccatttcttcttcttgtttaaatggtgcagagagaaaggttgcccagacatccaccagcttactgtgttgacagatttgggagcagcttttgatgaagttccacccatgagggtccatgtggcaagtagggccacagggcagcacctggttacaacttgctggtgggttttatgttgtgcaatactaggaggaggaggcaggtgatctatgctgatctatgatcacctgcttcagtagaatttttctgtagagtgttgtttgaattttgagcctccaggttagaggctccaagcagacaaagaagaaagtttgtagacacaatattctaacattgcacaagttgatgagatatcaagttttgaatattattcaggaagcactttggagaatgtgggagtcctactgttttgcactagtctgtaatttgttacctctccccattcgataatatagtaactcagaattttcatataaaattgaattctactcattagagtactttttaaaagtacagcagaaagaaaagaagtggaacataagcattca

SEQ ID NO: 79437 - DNA, 1361 bp, Homo sapiens
caggctggtgacatacttcgctggcgcatctccttactcactcttacttttccgacccctcaccattccctctcctgtggcttggtaaatacacctgccctccgtggaaggtgagtcctggactggcgttgccaggttcgcatgtcctccccagaacctccgtctggctccagggactctcactgagcgggtctagagcacccagcacttttcaaggaacagccgcggttcctttgtcccgcggctccagccccgttcggcccagctctcagggaaacgaagcgctcagtaagaacttttgatattagtttgtatgggtatttacactctggtgaggggagctgagtacggaagttccattaatcataccccaaccttgggtttagatattcagtttatgggttgggagagggagtttgccggaaagaaagcatcaaggttggccgctgactccagagaaatgaaaagggttaggtcgttttctgtttctggaaatcaagaattaggaatgggcaactacaggtgctaaccaacagaccacttttttgttttttggtagccctttggcagggatagtttttccacctttgcccgatacaatttaaaaaaaaaaatccttttattatggaatttgtcaaacacacacacaagcataacaaacccctaggtacccatctccaagttttgacccctattataatttcatcttcagtgttttattatccacttcctctctctctatctttagtattttaaagtaaatcccagatagcatcacatcatttcacccccaccataggatttcaaagatctgttatatttcaagattgagtaaaagggcttgaaattgggttattgcaatgaaactctagaaaaagcttgagggttcacccaggagtaagctggacaaaaaaggggtttgaggggtggacccatcttgcctaaaaatcttgtctcatctttctaaaaattacatatgaaagaggaagatttatgttacttttttatatgagagaatcgtcctttaatagaaaatttctattgctgcatcagaattatggaggaacacaaaaaacatacctcagtccttagtgtgtcctaaattaacacatattcacttattagtgggtaaatgactatatttcatttcagcacaacttctcccctggtagaaacacaaaagaaatttctaatgattaaactaggaaagtttgcactgaattgatggcttatcagagcaaccgcagttttcaggaagaaattcaatgccatgcggttgaaaatatccccctagcaataagggattatttttaaaaaagaatgaataaagatgttctggttttttttgttttaatctggta

SEQ ID NO: 79438 - DNA, 333 bp, Homo sapiens
cctgtttatttgaatactgctttccttaatgctttagaaatcaaaattgtatcattaattatacttacatttgtctggactctaaaaataatataatgcccaacagttgttttagccgccacaagttcctccacttccagaatgcatagccctttgcaatgtgactttgctacttttcccacccagaagtggaatcttctccatcccttggaatgtggcctggtcttgccagttgctttggcttatgggatattgcggaagtaagtatgttgcacaggttctggaatctagaccccaaggagcttttgcagcttccatctttgtcttctagaa

SEQ ID NO: 79439 - DNA, 260 bp, Homo sapiens
agtctttttcaagccatttgattaagtcaaggagaaagtctctgttgggtgcttctgtcttgaacactttctgacatttgtttatcttcctttccatgccttcagctggaaacagtgtggagccaaatagaaccaaatggctccgttcggtttcattgtatttatttgtgtggttatctacctatttggaattggcaccatcttttccatttatgacagtgatatgttttctttctaaataaataatcatcagttttttt

SEQ ID NO: 79440 - DNA, 376 bp, Homo sapiens
gtgggagggatggttttgggatgaaactgttccaactcagatcatcaggcattaattagattttcataaggagtacaacctagatccctcacatgcacaattcacagtagggtttgtgttactgtgagaatctaatgcctctgcggctctgacaggagactgagctcagtagcaatgctcacctgcctgctgctcacctcctgctgtgcggcccaggtcctaataggttaccagtcctaactggtacctaacagggtacaaagtccacagcctgggggttgggaacccctgctctagaccagcactgatggtaggttttatacatcagtggagtttcacgtaaaagtttggggaaaaaaatgattcttctaccagg

SEQ ID NO: 79441 - DNA, 351 bp, Homo sapiens
gagacagagtttcgctctgttgcccacgctggagtgcagtggcacgatcacggctcactgcaacctctgcctcctgggttcaagcaattctcctgtcttggcctccccagtagctgggattacaggcgtgcgccaccatgcccagctaattttcgtatttttagtagagacgggtttcaccatgttggctaggctggtcttgaattcatgacctcaggcgatccaaagtgctgggactacaggcgtgagccaccacggcctggccccttagaaaaaaaaccagggtctcactctgtcactcagaatgaagcgcagtggtgcgatcatagctcactgcagcctcaaactcct

SEQ ID NO: 79442 - DNA, 603 bp, Homo sapiens
tcagagacagggcctcattctgtttcccaggctgtagtgcagtggtgtgagcatagctcactgtaacctcaaatgcctgggctcaagcatagctagaactacaggcatgcatcaccatgcccaactacttcttttgttaattttgttaattttttggcagagaaagggtcctgctatgttgcgcagactgatctcaaactcctggcctcaagtggtcctcctgcctcagcctctccaagtgctgtgattacaagcatgagccactgcacccagccaaaattttatcatcttaaaaagtatggtccctaggccctagactgtgattaaaatactactcccattcaaggaaacaggcttccatagagatatggttgatttcaggtctgaggcaggaaatgtacaaaatgggcctggaatattgtataccagaaagcaattaactaactaactaccaaaggggttgaaaaaaacaaaaccacaacaaaaaatatgaagttacttagccaaaatggaacaatttgagcactacaaaaattataaagacaactgactgaaaaatataaaacacattaaaagcccaccacaataatatcaaaatcaaac

SEQ ID NO: 79443 - DNA, 1165 bp, Homo sapiens
gaattagcaagtattccttcttcatatattatgtcggaagagtttgagaagaaatggtattaattcttttttaaatgttaggttgactcaccagttaatgcagctatatggtcataaatgtttctttgttaatcgctttcgattactaattcaatatcctaggttataggtctattcatattttctctttcttctggagccactttcgtagtttgtatctttctagtgattcgtccatttcatccagggcagctaatttgttgttagacagttgttcacagtatactcctgtaatccttttgtatttctgtaaagttggtagtaatggctctgctttcatttattattttaataattagtcttccatcttttgctcagtcaatatagtgaaaggcttgatctttcaaataatctatgtttattcattctactgctctccaaacttctattttattgatttatgctctaattatgctctctattatttctttcatactgctagctttggatttagtcttattttgtcttcttccactgcctttaggtatagagtgaggatgttgatttcagatttttcttaaatgtagttgtttatatccatacattttcctttgaactctactttcactgcattcaataagttttggtatgttttgtttttattttaatttatctcaagatattttataattttgcttgtgatttatttttttcactcactggtagttgaagactgtattgtttaatttccacattttcgtgaattttccagttttcacttatttatctgttgtttcttccattgtggttgtaaattatattttgtatgatttcaaacttttaaaaatgattaggacatattttgtggacgaagatatggcccatcctagagaacttccatatacacttgaaaggaatgtatattctgctgttgttggatggactgtcctgtatatgcgtattagctctcagtggcttataccgttgtttaactcttgtatttctcatgaagcttctgtctggtttttctatccattaattaaaatgaggtattgaagtgtccaactgtgactatagaactgtgggtttatcctttcaatcctgttaattatttcagctttactgaggtgtaatagagaaataaaaattgtacgtgatgcgttta

SEQ ID NO: 79444 - DNA, 173 bp, Homo sapiens
gggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctcccacctcctgccagag

SEQ ID NO: 79445 - DNA, 346 bp, Homo sapiens
ttcagccacttgcagagacagccagagagtgcttcaaggactgcgtggagctctggagaagcagggaattcagggccctcttttgtgaggcatgagaaatttaggcaggatcatgtctacaaaagaggctgtcactttggcttatcaatattttcacctcgttaccccttccagatcagaatgggtgctttatttgtttttatggattattgtgtcaaccaaaacgagagttcagagtcactctaaagatttgaaactccttcaagatttgatgaatgcgcattttgatgccacatctatttttagaaagctgtggctgaataaagcattttattgtatagcatta

SEQ ID NO: 79446 - DNA, 261 bp, Homo sapiens
tgtcttgtttagtaagaaatcccttgccttgggatcatgaagaaaagtatttgtatttttttctacaaaattgattggctaaagcatttcacatttagatctatagtctatctagaattggtttgtatgtaaattcatttttcccttatatcctcgattttccaagcacaatgcattcaaaacatgatccctcactcacccactgctctgcagccaactttgtcatacatcagaatccatgtgtgcaagtgtctgtgtctg

SEQ ID NO: 79447 - DNA, 389 bp, Homo sapiens
gcagtattcatagcacctcagggctggccctgtggccttatcttggcttcctgcttacatcctgtgactgtctccatcctcagagtgtcccctcctagtttgagtaactgcagtgaatctgagaagtcctgcagtctttccagtctgtccttgtcatctaaaacatctccataggtgtcgtgacaaccagatgtttgtaggtatttctttttagttgtcattcattgactgcttatctggttattattattttttaaattataatttttttgagaaggagtctcactctgttgcccaggctggagtgcagtggtgtgatcttggctcactgcaactaccacctcctgggttcgagcagttctctgcctcagcctcccgagtagctggga

SEQ ID NO: 79448 - DNA, 414 bp, Homo sapiens
cagtgagatgaacccagttcctcagttggaaatgcagaaatcagctgtcttctgtgtcgctcacactgggagctgcagactggagctgttcctatttggccatcttggaaccctgccttcttcattcatatgtaatacaaaacttctaaggttttagtggagaagagatagagtaaaaggatttctatagacagaagaaacagttggtcatcaactctttcccttgtggcttcacatctcccctaaggacttcttatgttggtttggtcttacagtatagtcagtggcagtttccctcttcccattccttcctctgtctgatttaaaatgctgtttcaagtatcgatataagtattttgcctgtttcttttagcgtggctgtgaagggctgacattttcagaaggcacttactg

SEQ ID NO: 79449 - DNA, 838 bp, Homo sapiens
ttactcaagatgtaacaccttagtaagcctttctgactcctgatgggaaaagcagtttctattctacccactgccttatttcattagttaactttttaaaaatgtctctccaggccaggcatggtgactcccacctgtagtcccagggatttgggaggccgaggcaggaggatcccttgaggtcaggagttcaagaccagccttgacaacaaaacaagatcacatctctacaaaaaatattttaaaattagcagggtatggtggtgtgcacctgtagtcccacctactcaggaggctgaggtgggaggattgtttgatcccaggaatttgaggttacagtgtgctatgattgcaccactgcactccagcctgggcaacagagtgagatcctgtctcagaagaaaagtttctccttggtcataagtgtcatgacttcaaaaaaagttttacacacagaagtatagaaaattaagaaagccattttccctttttcctgtgtctctccttccctggcttagcatcattatgaattcagcataggtacttccagattattttatatacacatgcacttatttctttcatttggagtaccttatcttcagaagattataagctcattaaaggtaggaacctgtggcttttgcatttggttttcccacaaagcctcacacagaaatgggaggtgttcagtaaatgcttattgattgacagagttttaagggaagagttaggccaggtgtggtggcttacgcctgtaatcctagcactttgggaggctgaggcaggaggatcacttaagcccaggacttcaagaccagcttaggcaacattagtg

SEQ ID NO: 79450 - DNA, 309 bp, Homo sapiens
ctgagtatccccctcctatctgaatccagggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaag

SEQ ID NO: 79451 - DNA, 352 bp, Homo sapiens
  misc_feature (4)..(4): n is a, c, g, or t
tacncagttcgacggagactctccccattcatcaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttctctccgtcgacctggggatcctca

SEQ ID NO: 79452 - DNA, 262 bp, Homo sapiens
cgtccttcatcatacctaccctaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaag

SEQ ID NO: 79453 - DNA, 287 bp, Homo sapiens
tctactactaaattcgcggccgcgtcgatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatcttgatttctgtgaaaatgcatttctctggtcgacgcggccgcgaat

SEQ ID NO: 79454 - DNA, 145 bp, Homo sapiens
ctagaggatcccacatgatggtccacgctccaactgtgtttcatttgctgtaatcagtttttaaaagtcagatggaaagagcaactgaagtcctagaaaatagaaatgtaattttaaactattccaataaagctggaggaggaag

SEQ ID NO: 79455 - DNA, 3377 bp, Homo sapiens
  misc_feature (2489)..(2489): n is a, c, g, or t
  misc_feature (3374)..(3374): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79456 - DNA, 3399 bp, Homo sapiens
  misc_feature (2511)..(2511): n is a, c, g, or t
  misc_feature (3396)..(3396): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79457 - DNA, 3318 bp, Homo sapiens
  misc_feature (2430)..(2430): n is a, c, g, or t
  misc_feature (3315)..(3315): n is a, c, g, or t
atccttaattaaattaattcccccccccccccccgagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79458 - DNA, 3277 bp, Homo sapiens
  misc_feature (2389)..(2389): n is a, c, g, or t
  misc_feature (3274)..(3274): n is a, c, g, or t
ttagctagtacgaggctgggttggaacaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79459 - DNA, 1850 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaagggcgcacaaaaaaaacaaaaaaaaaaaaaaatttggggggccgcgcctcgaagattttcaaccttctggggccgcggccggttagtgaacgggctacggtcccaagaccggtcagacggggggtccccaaaaacccgggccggttcaaacccggttggtcttggtctccgcctcgcccctctcggcccgcgagcacccaaataggcaaaacaggggga

SEQ ID NO: 79460 - DNA, 1646 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcccctacagtcctcgccccccccctcgctttttccctccacccccacaaaaaaacaaaagaaaagggggtttgcctaa

SEQ ID NO: 79461 - DNA, 3345 bp, Homo sapiens
  misc_feature (2457)..(2457): n is a, c, g, or t
  misc_feature (3342)..(3342): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79462 - DNA, 3277 bp, Homo sapiens
  misc_feature (2389)..(2389): n is a, c, g, or t
  misc_feature (3274)..(3274): n is a, c, g, or t
agctagtacgaggctgggtgttaattggccgaggcttcccccggctgtgttcgagtctccgcgctgcgggccgctccgacgtcgggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79463 - DNA, 1392 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagataggcggaggtggaaagggcccggttaccggcctcgtgccg

SEQ ID NO: 79464 - DNA, 3212 bp, Homo sapiens
  misc_feature (2324)..(2324): n is a, c, g, or t
  misc_feature (3209)..(3209): n is a, c, g, or t
aagcagtggtatcaacgcagagtgcccattacggccgggtgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79465 - DNA, 3365 bp, Homo sapiens
  misc_feature (2477)..(2477): n is a, c, g, or t
  misc_feature (3362)..(3362): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79466 - DNA, 3343 bp, Homo sapiens
  misc_feature (2455)..(2455): n is a, c, g, or t
  misc_feature (3340)..(3340): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79467 - DNA, 3494 bp, Homo sapiens
  misc_feature (2606)..(2606): n is a, c, g, or t
  misc_feature (3491)..(3491): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtattttgtcgaatagaaaaatttgaagtacttcagtatttgttagtatcaagactggtctgactagccgaattctttgtttttgctcaaaacaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79468 - DNA, 1380 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcaggcaagggaatcacttgaacccgggggacagaggttgcagtgagccaagatcgcacactgtactcagacctagtgacagagcaagactccatctc

SEQ ID NO: 79469 - DNA, 3339 bp, Homo sapiens
  misc_feature (2451)..(2451): n is a, c, g, or t
  misc_feature (3336)..(3336): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79470 - DNA, 2872 bp, Homo sapiens
  misc_feature (1984)..(1984): n is a, c, g, or t
  misc_feature (2869)..(2869): n is a, c, g, or t
gctgacctgaggttccctttctctgatcgctcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79471 - DNA, 3264 bp, Homo sapiens
  misc_feature (2376)..(2376): n is a, c, g, or t
  misc_feature (3261)..(3261): n is a, c, g, or t
atccttaattaaattaattcccccccccccccccgagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79472 - DNA, 2540 bp, Homo sapiens
  misc_feature (1652)..(1652): n is a, c, g, or t
  misc_feature (2537)..(2537): n is a, c, g, or t
catgcctcatccagggcattccagtgtcatgccctcatccagtgggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79473 - DNA, 2198 bp, Homo sapiens
  misc_feature (1310)..(1310): n is a, c, g, or t
  misc_feature (2195)..(2195): n is a, c, g, or t
ctcaactgtatgttctatgtagggccttgatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79474 - DNA, 2076 bp, Homo sapiens
  misc_feature (1188)..(1188): n is a, c, g, or t
  misc_feature (2073)..(2073): n is a, c, g, or t
ctgagtatccccctcctatctgaatccagggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79475 - DNA, 2029 bp, Homo sapiens
  misc_feature (1141)..(1141): n is a, c, g, or t
  misc_feature (2026)..(2026): n is a, c, g, or t
cgtccttcatcatacctaccctaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79476 - DNA, 1821 bp, Homo sapiens
  misc_feature (933)..(933): n is a, c, g, or t
  misc_feature (1818)..(1818): n is a, c, g, or t
ggctgatcgagggttcctatacacctatacacacaccttctcattttagtgaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79477 - DNA, 515 bp, Homo sapiens
  misc_feature (475)..(475): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatggtaagtatttaacacttccttttcataccccnctagagcttgagaggtgagcacatgcaactgtgtatagca

SEQ ID NO: 79478 - DNA, 373 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtcagggtcgacgcggccgcgaatttagtagtagtaggcggccgc

SEQ ID NO: 79479 - DNA, 2873 bp, Homo sapiens
  misc_feature (2870)..(2870): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79480 - DNA, 1632 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaag

SEQ ID NO: 79481 - DNA, 2076 bp, Homo sapiens
  misc_feature (2076)..(2076): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaagaaaaaaaaaaaaaaaaaaaaaaaaaaaaaaaacaacaaaacaacaaacacacaaaaaaaaaaaaaacaaaaaaaaaaacacaaaaaaaaacaaacaaacaaaaaaaaaaaaaaacaacacaaacaaaaaaaaaaaaagagggggggagcctaaaaaatcacgcaagagaaccaataaatagtgaatcagacgagtttattgagaaaaaggagggccctataaaatggggaagaatttataattacaggacgacgacgcgttaaaacacactgatgggggaaaaaataagagtggggtattatgagaaaacacatctggtgggatgaaaattgagaacatcgccaagaggagtaagccagcagaaaaaaaaagggagattagtggaaccaataattgggcgaaaaaatggactggttattgaatttagggggtcgtattatatgn

SEQ ID NO: 79482 - DNA, 3296 bp, Homo sapiens
  misc_feature (2408)..(2408): n is a, c, g, or t
  misc_feature (3293)..(3293): n is a, c, g, or t
gccaagaagacaacaagggtacccaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79483 - DNA, 1394 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcttaatcccagggggataaagctagctagggagtgtggggtggggttgcgtggaggggagatgttggagtggtaggtgtgtgggtggtgtgggtggtgtgtggtgagtgga

SEQ ID NO: 79484 - DNA, 3284 bp, Homo sapiens
  misc_feature (2396)..(2396): n is a, c, g, or t
  misc_feature (3281)..(3281): n is a, c, g, or t
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagatatttaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacangtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccanaaa

SEQ ID NO: 79485 - DNA, 777 bp, Homo sapiens
ggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggttggttttacctcggatagaggtttccagtttgtttcctcgtctcttccagatatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaaataatctagctgtaacctcaattgtgcattcccgtgcagtc

SEQ ID NO: 79486 - DNA, 820 bp, Homo sapiens
ctctgaagcacgttgggtgagagaaagaaagaaatcatatcctttatcctcccacacagccaaagattcctgaagacagagctgatgccatgtactcaagtgggtctctgcctctcagaggtggccttggtcttcaagtttcagcaattctgggaagccaaggacacctccatctcctcctccctgatctgcaactcatctgagagcagctttctcattggaatgtcttgtgtttaaggaacaagaatccctgtttccggtttgggtgcccaagtgcacctactggatccaacccaggattggagatactttgcagaacacaacatcatctggcacatgaccagccatggtgtttcactttcacaatttcagcttccttcactgattgcagcataatcgtggttcagcagcctccaagaccagggctgatgtgggcggctacagggagaaattcaagaggaagttcttggtggtgccctccatgagtacaaagaagcctcagtccccaggacacccttccgtgcatggtgtcactgacatctttatttcttttgtcacgttctgtaaatcacaatgaatggggtattcttcttctattatatatttgttaagtcttttttggcatctttaaaaaaaactggtaactttatcctatgtaatatccctgttaagtcctaaaagtcttttctgatgtctattttgtctgaaatttgcacagctactatagctttatttcggttcatattttcataatccatgttttctcatccttttatatttgtgaatgtgtaaagtaactttcttgtgcatagctaagagt

SEQ ID NO: 79487 - DNA, 751 bp, Homo sapiens
aatgggtttttgtttatctgtattttattcagagttccttggtttgaacctggtgtcctgttccaggcatccagccaggatactacattatgtttagtcattgtgtgttcttaggctcctcttggctgtactagtttcttagaatttcctcgtttttgattgtctggacatgatgatcttgacagttttgaggaaaagtggtcaggtattttgtagaatgtccctcatatgataaaaagttttttagttctttgtgcatttcttgcccccactaacacaaaatagactgtgaaagtgccattattaaagatacattaaagtatgagagaaagataaattcttataagaatctgggaaggcttttcatcacaagtaatgttgtccatgaagtaattagttgtgtttgtgatagaatagggggtgtcacgtgaaaatcaagagtgcaggtcatgttctagtaacagactaatagaattgcaatgtgatgcgagtaaggtgcaattagaagtaacagtgttaaagtttggcaggggcctgagagcttttttccctcctgacaccaaataaatggtatcttttccaacaacacttctctaactctctgacatcaactatgtgtcctacaattctgacactaactacccagaattaggatcagattccacagattcaagggctcagtcctacaagattgccctcatttctgatgccagttgcaagtattaggcccccagattagtcaggcattctc

SEQ ID NO: 79488 - DNA, 869 bp, Homo sapiens
caatcactgaagtgagtaagggatgcagtggtgttatttgttgggcagaataaataagtgaattttggcatagagtttctgaaggcataactatgaaggcaagagaataggcaggcaggataatgcattctaggtgctttccaaggagtcagtgttgtttaggcagctattcctgccaccagggagaggagttaattcttgaaaaaaaatttaattttttatgagaacagaagttgattcaatatccttcttagagttgctcatcagaacataaatgtcactttctagtaacatttttgatggtttccaaaccaaaacaagttccaggagggcattcgagatgtatacatcatcaataattactcttatgttaaaagttgctgttttcccgtagctttgccaccatttataactcaaaagcctgatagtgctagggaatgtaaagatgtttctgtctgctaagtgttatactaatcgaagagaaggagaacttttatgataaagtgacatgtacagaacctagccaagttacaatttttggtcaaaatacttgaaactctttaactctaaaagtttaaggtcaataggtgcattataaagtaaattttaagccaggcaaatttctagtcattaagtcagtattcattgccttagtcagccattggctgtatataatccttaatataaaaaccatctaatgactaatatctcttgcatattgtgaagtaagttacctatagaaattctgtagtaccataaagaaaagccttttgagattgcagtgagctgagattgtgccactgcactccagtctgggcaacagagccagactccattgaaaaaaaaaaaaaaggctcttgaatgatgta

SEQ ID NO: 79489 - DNA, 896 bp, Homo sapiens
ttttttttcaatggagtctggctctgtggcccagactggagtgcagtggccaatctcagctcactgcaatctcaaaaggcttttctttatggtactacagagtttctgaaggcataactatgaaggcaagagaataggcaggcaggataatgcattctaggtgctttccaaggagtcagtgttgtttaggcagctattcctgccaccagggagaggagttaattcttgaaaaaaaatttaattttttatgagaacagaagttgattcaatatccttcttagagttgctcatcagaacataaatgtcactttctagtaacatttttgatggtttccaaaccaaaacaagttccaggagggcattcgagatgtatacatcatcaataattactcttatgttaaaagttgctgttttcccgtagctttgccaccatttataactcaaaagcctgatagtgctagggaatgtaaagatgtttctgtctgctaagtgttatactaatcgaagagaaggagaacttttatgataaagtgacatgtacagaacctagccaagttacaatttttggtcaaaatacttgaaactctttaactctaaaagtttaaggtcaataggtgcattataaagtaaattttaagccaggcaaatttctagtcattaagtcagtattcattgccttagtcagccattggctgtatataatccttaatataaaaaccatctaatgactaatatctcttgcatattgtgaagtaagttacctatagaaattctgtagtaccataaagaaaagccttttgagattgcagtgagctgagattgtgccactgcactccagtctgggcaacagagccagactccattgaaaaaaaaaaaaaaggctcttgaatgatgta

SEQ ID NO: 79490 - DNA, 547 bp, Homo sapiens
agaatcaatattagggaattgcgccccagagccaaggattccgcacgaagggaccgagtaaataggggtagaatagaatagaccgtctacagcgttcctggacgctaagcctaagaattgcttcgtgaaactccagtttcgttttatgaacgcgtgtgtgcgggaggcgacgtgaactgacttgactgtgggtacgaaaagcccaaagccaccgcccaggaagaaccgcgcttggctgcggcccgggaagaaacatccacggccgcgttagaaagagggtcgcacgctgccgccgaggtagaggggtccccgagtcctggggcctcgcgccccacagcccgagtcccttccccgcggggctggtggctttgggtaggacgcgcgcttggcgcggccagccctgcggcaggagctgagcggcgcagggacacgggcagctgggaggggcgcctggtgatttactcacttccctcctagccagagaagtgcagcaattccaaacagttctcataggagcgtccctgacaacttcatgttataaaaaaaa

SEQ ID NO: 79491 - DNA, 701 bp, Homo sapiens
gaaggttgaggaattgagcctgccctgtgaggggactttggcaaaagggtggaaggtatttgcagcttgccaacaacgtgttctgcttgccaaggacagatctcccttaatgtacacaattcacagaattcagaggccaaggataattttccttggaattagagggtctgaggcttgtgtacatggcagagaataatgaacgaaatttttgaaccacttaacttgaactatatacagtcattggtttccataggccctttcccataaacttacagtattgctggactatgacacctaccagatgcttacttaactctggtctgccttggaccagagtgctttgattcttttttaaaaatatctgtgattcgttactttggggctaggagggcgtgtggttaagtactattgcaagaatctgtaagctgcccggcgcggtggctcatgcctgtaatcccagcactttgggaggcgggtggatcacttgaggtcaggagttcgagaccagtctgggcaacacggcgaagccctgtctctactaaaaatagaaaaaattagctgggcggggtggcacccgcctgtaatcccagctactcaggaagctgaggcacgagaatggcttgaacctggcggaggttacagtgagatcatgccactgcactccagcctgggtgacagagccagactctgtctcaaaaaaa

SEQ ID NO: 79492 - DNA, 358 bp, Homo sapiens
tataatttgggtgggaatccagcactcttgaaatagtcatggccagagagtatcatcaaattaactacttagctcagttcacaagacttcatttgtgctcagcaaggactatcactgaatagggaacagcctgaatgtagcaagctttccactgaattaagatagtgtatatatcttaaggtatgttgcttgtctgtcttctaagaattttttaagctacatttgaaaaaacatgataatacaattgtgagtctccttagtgttaaatttataattagataggcaaaatagtaagtatatgtgtgttagagattcaagtaaaaaaaaaaaaaaaacaaggcccagcttgtgacatagc

SEQ ID NO: 79493 - DNA, 700 bp, Homo sapiens
acaaagccaattggaaatgggtctggttgacagaggaatcagaccatcacttcctccaccaggtcccacccaccagcgaggctgcagttcttgttggacagctacacttccctgttgctccatcctcttgtccttctctgatctctttttagaatcacttctccctctatctttgttgctgacagattcaaatctacactcgttaaagaaaggaataaatctcctggttaccatttgctagatagtttatccaggaatcacttaactctactacttaagtcaattctgtagttaggaccaaatttttaaaattacaacgccatcacctcctttaaaacaaagtaaattcaaacaggaaagctcaaagtgttgttgcagaaacatataactcctcttggtttgatcccaatgacaaggtgtttttttttaaggaaaagaaatattgattcagttctgaggggtatcttattcaagagaagtccagactttctttcttgtgggtggggacactttaaattcttttaaatgataactttattgaagatataacttaacatgatttatgccctggtctggacctatagattcttagaggtgtgccagggtgggtcagtgggaagctggctgtgctgcagcttccgtgtggctgctgagcggactgagagtgggattctgatgtcttccagtgaaacagggactg

SEQ ID NO: 79494 - DNA, 293 bp, Homo sapiens
ttgaaatgttatacgctaaccagacacctcattcttcattcaaacctaggctaaatgacattggaaatggagactcttgtgattgttacctctatgcaacagaatgttaagcaaccctcttagagtgtaatcaatagcagccaatcaaatcttacacatgagcctttgtagaggaaacgtaattctgttcaacaccaccattttgttttgttttgatttgtataaacaatcctcattttttcccacacttggtgcaactgatcaccattcttgggtgtagctctgcttccctg

SEQ ID NO: 79495 - DNA, 464 bp, Homo sapiens
ggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctac

SEQ ID NO: 79496 - DNA, 857 bp, Homo sapiens
attgaaattctaaccccaactaccacacagagtgaccttatttggaaatagagtctttatgaagacaattaagatgtggtcattacagtgggctctaatacgatttgactggtgtccttgtaagaaggggaaatttgaacatagacacatacatagatagggaaggaaatgcgaagacacacagaaagatgaccatcttacaagccaacaagagaggtcttaagcagatcctctcacaacctcagaaggcaccaacactgccaacatttcactctctgacttccagcctccagaagtgtgagacataattttctgtttaaggcgcctgattaataataatttgttgcagcagccacggcaaacggaaacatttgggtttctaaagacggaagcagctgggcgcggagactcaggactgtaatcccagcactttgggaggccgaggcaggcgaatcatgaggtcaggagatccaggaccatcctggataacacagtgaaaccccatctctactaaaaatacaaaatattagctgggcatggtggcgggcgcctgcctgtagtctcagttactctggaggctgacgcaggagaatcacttaaaccagggaggcggaggttgcagtgagctgagatcacaccactgcactccagctagcatgacagagcgagactccgtctcaaaaagaaataataataaaataaagaaggatgctctgaaaagggaaaggagaaaagggaggcatttgtggagtaggtgctcatcactttctcaaggatatttacaaatgtaatcatatttaccgcacagaatcctcgtaaaagtgacttaacttcctgacagagcatgagcaccatca

SEQ ID NO: 79497 - DNA, 530 bp, Homo sapiens
  misc_feature (451)..(451): n is a, c, g, or t
  misc_feature (505)..(505): n is a, c, g, or t
  misc_feature (515)..(515): n is a, c, g, or t
cacatcgccactaggtggcaggctctaacagcttaacactgagaagggcaaaatgagatgaaaaatgtttctaataatgaaaaccaaataacctttaaagatcaagcccacacataagaaccatctttgaaaatgatgagatttatcactaacatttttacaaatctatgagtcttaaagccatgtgatatttccagtgatgttcattttgtaattgtgttgctttgaatcttcctctttctaagcttaatcctcagactttacgagacatgtcttgagggtgaaaatgcagtaaaataaaattcttgtttttttaaagaagagatccacaatgtctggtgtttcctaatgtaaacaaaatgatcagatttgatgtgttagaactcctaagcattttgaaggaatttccctaagcagttggggaagagcaaattgtatgcatgtagggcanaggttttgaaggtacatttgcaagaggtatttgtttaaccaaaatatttgggangtaacatttnaggcctttaattttc

SEQ ID NO: 79498 - DNA, 331 bp, Homo sapiens
gaaaaaagtaattttcaaaatatgtagagcatgataccatccaggcaaattagaaaagtaaagctgtatatgttttccacataaacatgtatgtaaaagtataaaaaagacatttgaaggttataagcaatttcagaacagtggttgtttctaagggcagagaaggagaatcaggatgtggatagtaatcaggagggcctttagtgttatttgtagtgttcttttttttttatttttacaaatgtatggtgtaacatgaattttattacatgtatgtaatttatagtgatgaagttagggtatttagagtgtcagtcacccaagtacaata

SEQ ID NO: 79499 - DNA, 555 bp, Homo sapiens
ttctttaagacctatcagatttcttctttcagacatagttacatttacctctatttgtaaagactgctctcctggttcttctcttcctgtctggcatctagcttttttctcctctgtttacatttcatggtgtgtggtcctcagctgcctccagcttcattcacattttagctgtatctgtggctgctattttctctaagtcatattcactgtgttttatcaaaaaatcagacacaaagaatttatgcattcattagcaaagctagtttcttataatatgactgtaaattcttaagtgcttttaaaataaatgttctatctcatctggtactcctaacatttgtgttgccgtggtaatttattttctggatgtgtttattacagtgttatcacatattttgtaaaaggtcctttacttttaatgtttttaaaaattatttaaaaataaaatcgtttttcgttctcaaaacacaactgattttctaatgtaagacattaattcagatcaacaaggtatatgatggataacactgttatcattgcattattcatgct

SEQ ID NO: 79500 - DNA, 273 bp, Homo sapiens
cacatgtatgcataagaatgctcaccaaactgttaatgctagtaatctgtgggtggcggtattcaggagtttttacttttttatattgtttgaatttttaaaaataatatatattttttgtaacctgaaaaaattttttaaataagtaagtaaaacaagtccgggtgcggtggctcacgcctgtaatcccagcactttgggacgccgaggcaggcagatcacgaggtcaggagatcgagaccatcctggctaacatggtgaaacccctgtctc

SEQ ID NO: 79501 - DNA, 2066 bp, Homo sapiens
  misc_feature (851)..(851): n is a, c, g, or t
  misc_feature (853)..(853): n is a, c, g, or t
ctgcccccaaccccacaaaccattttctcagttgttcttaaggtattcatttaattcatcaactttttattgagtttaggaccaaatgccagcaattcagccaagttctaaagacacacatttaaattaaacagttatcttcaaggagcttggtgtctgcagttcagtagacacttataacaccaacagtaccattcatttgctgtgccctctgccgggttgctcttctcccagtgtttcatatggctggctacttcttatcctttaagatctctttttaagattctttctttctttttttttttttttttttttttgagacggagtcgtgctctgtcacccactgcacttcagcatgggcaacacagtgaaactccgtctcaaaataaatagtgaaataaaatcttaggaaaatgtgcacattaattcattcagtgttcttctaacacatgtgctaagtgacccctgtgttcccagatagttctaggtgatgcgaatatacagtgatgaataaaggagatatggtctttagacttttgagagtttaagtcatagtggaaggagatagacagtaaacaagtaagctaataaaagagcacctgatagtgatgagtgctgtgaagaaaataaaatattagtgtgaaaataacaggggccgggcgtggtggctcaggcctgtaatcccagcactttgggaggcccaggcgggcgaatcacctgaggtcaggagttcaagacaagcctgaccaacatggagaaaccccatctctactaaaaatacaaaattagccggggtggtggcacatgcctgtaatcccagctactcaggaggccgaggcaggagaatcacntnaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacatctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacactagttg

SEQ ID NO: 79502 - DNA, 110 bp, Homo sapiens
atttgaagataatatttgaagatattatattacaataaatttctgttcttactcattggagcttgatgcccctaaaaacttcgtcattggaaccacctctggtgctttaa

SEQ ID NO: 79503 - DNA, 470 bp, Homo sapiens
ccaacagcaccgggtgcttctctggggtcatgcacagctcgttgtagaaggtgtggtgccagatcttctccatgtcatcccagatggtgatgatgccatgctcgatagggtacttcagggtcaggatgtcgtgcttgctctgggcctcatggcccatgtaggagtccttctggcccatgcccaccatcacaccctggtgccggggtcacctgatgatggaggggaacacagctcaggggccatccatccccagcaaagccagctttgcacatgccagagccattgtcaatgatgagcgcggcgatctctatttccattgcaacctgtggaagagcagggcggtggagccatgggaagacacggtgtgggggctggtggcagcaagtgactgtattactggattttgaagttaacaattagccaaatactgatttttgatggaaatttattctgaattattttcttttaga

SEQ ID NO: 79504 - DNA, 455 bp, Homo sapiens
tgctggggagcagaagatgggttgctctgacactgtattctcctgtgaccaatagcctgtgttgtcacagctttaccaataataggtccccttgctggagagccacttcacagctttccctattgaattcaggtcaggtctccacttcttactttaacccaatcttttacggttctccagtctgcttgcaaactcctagaattaattacatatttataagtactgtgcatattttatattttctacatttgatgtgatttttgttggtattctgtttcgtattttcaactctgataataacatttctcataaagaagactatccttacaacatgtcttcatttagaaaaagtattgctgtagatgaaattcagtgagtttcaatttgatgattttgtattaaaatgcatttctttaggcatcaatattgcagtaacaattattgatgtgttacaa

SEQ ID NO: 79505 - DNA, 227 bp, Homo sapiens
gaagggtggaaacacattagatagagttcttgaagcgggtacttttcacagctacttacattgcattggccaaagccagtcagacagccaagccttacagtgtggttgggaaagtaaaccctgaccccagagaggctctgtgggagtgtgggtgtgtgttctgccttcagaaaaagagcagtgaatcactgagggcagtaacacaatctaccacagaagggagttac

SEQ ID NO: 79506 - DNA, 622 bp, Homo sapiens
agctcacaaagcacctactcacttcatccccacaacaggcgtaaagaggtagatatttggacctcgtttcacagacaaagaaactaggcccaggaaagtggcgttgctctcaaggtcacgcagctacaacgggaaacgggctgagccgggactcaaaccaattacccagattgagaattccgggctccgaaaaaaactggaaacagaaagggagggaaaaaaaaccataaccagggtctgcccaagtggaaaggtggtctcgaatagaatagaactgttttgtgctatggaagagcaagggtgagatgaggggaaatgggagtgactgctaataggtatgggatttcgttttgggataataaaaatgttctaaaaaaaaaaacaaaaaaaaaaaaagagcacaaacagaacgaaaagaaaaaaaacaaaagaaacagaacagaagaaagagaaagagagcagggagcgcggaggggcaggagacgccacacactgaacgagaaggatgagctaggaaggtaggacagggggtgggtggaagaggagaagagggagggaggagagagtggggagaaaacaatactgaggtgtgcggtggtgcggagggagaagttgggagaag

SEQ ID NO: 79507 - DNA, 145 bp, Homo sapiens
tccgaaagtgctgggattacaggtgtgagccatcgcgcccggcctgtagttttcagtgtataagtcttgcacttcttttgttcctaatttttcaagtcactgttatatggactttctgatacataaggccaaattgaactcatga

SEQ ID NO: 79508 - DNA, 286 bp, Homo sapiens
tttggggggctgcgatggaaccccaatctccgtggtggtaccgaggtgtcaggcacactgaccgactccttggggtcccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcagccttgccaacattccactaacccccgatacaggg

SEQ ID NO: 79509 - DNA, 769 bp, Homo sapiens
taatttctaagcagcactgggactgtcatcttcccagaatggatttttcaacttaacagaggggttttgaaagtttgttcctgggtcaggcgtggtggcttatgcctgtaatcccgggacttttggaggttgaggcaggaagattgcctgaggtcaggagttcgagatcagcttgggcaacatagcaagaaccccctcgtctctaccaaaaatacagaagttagctggggatggtggcgcacccctgtggttccagctactagggagggagcagtaggaggatcgctggagcccaggagtctgactgcagtaagctatgatcatgccactgcactctagcctgggtgatatagcgagagcttgtctccaaaaaaaaagtaaaaggagtttgtttttcctgtactctagcgggcctcccctgctgctttgccaggcttttttctgggctatgtgttttgggggtgacagtggctggctgagagcccccactgtctcctggctggccatgtatccccggccgagccttctcagtggttcgtccctgtccaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctccct

SEQ ID NO: 79510 - DNA, 2153 bp, Homo sapiens
gacctgcaaacacacacacacacacacacacacacacacacacacacacacatacacacgcaccagggcagccgagagacctccctcccgcccctcccatgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttctttttttttttttttacaattttgaggtcttcgtgttcaaggagaagctattatattttgttaagaaagtggggagaaaaaaaccaagaggccaccgtgcctttgtaaagaaacaaaataaagtttgtactttgttttttaaaaaaaaaat

SEQ ID NO: 79511 - DNA, 2058 bp, Homo sapiens
gacctgcaaacacacacacacacacacacacacacacacacacacacacacatacacacgcaccagggcagccgagagacctccctcccgcccctcccatgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttctttttttttttttttacaattttgaggtcttcgtgttcaaggagaagctattatattttgttaagaaagtggggagaaaaaaaccaagaggccaccgtgcctttgtaaagaaacaaaataaagtttgtactttgttttttaaaaaaaaaat

SEQ ID NO: 79512 - DNA, 394 bp, Homo sapiens
cacaaaatggtgttggagtttgtcaaatactttatctgcatctattaagatgatcatgcaattttaatttgttattgatagaatagaatgtattacattaatagatttttgtatgctaaaccagccttgcattcctgggagaagtttcacttggtcatggtgtataatgctttgtatatattgctgaatttggttttgtagtattttgctgaggattttcatgtctatatttagaagagatattggtctgtaattttctttttttgtggtatccttctctagttttgtcattagtgtaatactgactttattttatacataaattcataaattgcatatatttatggtgtacagtatgatgttttgaaatatattgacttcattaaaatgaggt

SEQ ID NO: 79513 - DNA, 1135 bp, Homo sapiens
cctttctgcacatttacattccactctctaaaccaaactattttagatcccttgacacattttgttattattattattttgatgactcacttttgatgtttaggcttaaacttctctaagcagccattttcttccatgtctcttcccccacgtctgtcctcacatccccacccctaagttttgaaggttgggtgctagcatcctttgctgcctctgtcagagcactttctgcaccatgcatggtaagttgtacggctgtgtcttcaattgtactgtaatacttttcagagtagagacagagtcttcttcctctgtatctccagtatctagcaaaagatacacctttggttttctgtgtttggtttcttaattttctaaattaatgagaaacattttgctgtttaggatcattggcccacggaatttttggcaaaccgtgttcatagacccaaaggaagaggagttaaaaagcctgttgccgagaactcagtctcttgcctgaacatatttagttctgttttccctgtcaaatttttcagtgcatggaaagcacaaaacggggccatagtgtgttgtaatcctgatcttgaggctcaggggaggctaggagtccactcgagtcctgggctcctgccctgtttggcctgtgcccatgctgggcttcagaacagaagctgcataagctccccaaatgagcttattctcctttgcctttcaactctcttcttccgttatcctcccaggtatttaggattatattaggttttcagttcttatcacctttcttctcaaggttctaagaagtccttcatgcagatttgtagtctctgagctttcatttccaggagctgtttgtgaagcactattacctactcgcccttacctcacagccctctctcctctagttttccctgtcacacaggtgacttttctccattcctgtgttcaaactgtctggatttcacagtgcttgacagaatcaataagaagaaaagctttcttgtttttctctctttgccaaaggacagatgaagacatcttggaaaagaagaaaagattgttgaggtgatgtttaaaagtggaactcgtgctgtgaagaaagcagcgggtagccatcctagagtacaggaaccaa

SEQ ID NO: 79514 - DNA, 1081 bp, Homo sapiens
cctttctgcacatttacattccactctctaaaccaaactattttagatcccttgacacattttgttattattattattttgatgactcacttttgatgtttaggcttaaacttctctaagcagccattttcttccatgtctcttcccccacgtctgtcctcacatccccacccctaagttttgaaggttgggtgctagcatcctttgctgcctctgtcagagcactttctgcaccatgcatggtaagttgtacggctgtgtcttcaattgtactgtaatacttttcagagtagagacagagtcttcttcctctgtatctccagtatctagcaaaagatacacctttggttttctgtgtttggtttcttaattttctaaattaatgagaaacattttgctgtttaggatcattggcccacggaatttttggcaaaccgtgttcatagacccaaaggaagaggagttaaaaagcctgttgccgagaactcagtctcttgcctgaacatatttagttctgttttccctgtcaaatttttcagtgcatggaaagcacgagtccactcgagtcctgggctcctgccctgtttggcctgtgcccatgctgggcttcagaacagaagctgcataagctccccaaatgagcttattctcctttgcctttcaactctcttcttccgttatcctcccaggtatttaggattatattaggttttcagttcttatcacctttcttctcaaggttctaagaagtccttcatgcagatttgtagtctctgagctttcatttccaggagctgtttgtgaagcactattacctactcgcccttacctcacagccctctctcctctagttttccctgtcacacaggtgacttttctccattcctgtgttcaaactgtctggatttcacagtgcttgacagaatcaataagaagaaaagctttcttgtttttctctctttgccaaaggacagatgaagacatcttggaaaagaagaaaagattgttgaggtgatgtttaaaagtggaactcgtgctgtgaagaaagcagcgggtagccatcctagagtacaggaaccaa

SEQ ID NO: 79515 - DNA, 191 bp, Homo sapiens
gggagggagggggagcccttggtctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79516 - DNA, 784 bp, Homo sapiens
  misc_feature (783)..(783): n is a, c, g, or t
ccgctgacaaagcacttctctgtagtcattaccacacctacttaagatactggttaagacttgtgacttacacagccaaagaatcagatagactgatatcagacttacaaatcaatatggacacacttccctaagggtaactgtaatggagaatacccatgttacgatttttttaagtaatttttttttatttttttgagacaaggtctcaagcaatcctcccacctctgcctcccaaggagctgggtcctcaccatcatcaggcgctgagctggtgtgaaatcagttcttcccgtgccatgctcctgggcttttctcccactataaataactccagccttctgacagaccacatgatctctccaacgctggacaatattcccaacactagtgttcctctgcccacccatcaaaaaagaggcaagactgagcccactgtaaccaggagcaacaaagcaggcagacacgttggtgtcaggggcaaggacagaactcagcaaagccaggagggcttggctctctggctctggtccccactccaggaagccagacgatttcctcagcagtgcatcctccctgtggtttcctctccgagttcttaacacaatccagcaatggtgtaaattttctccctcatcttctcatcctgaaaaagcacttctctgtagtcattaccacacctacttaagatactggttaagacttgtgacttacacagccaaagaatcagatagactgatatcagacttacaaatcaatatggacacacttcctaagggtaana

SEQ ID NO: 79517 - DNA, 4398 bp, Homo sapiens
tcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79518 - DNA, 3573 bp, Homo sapiens
tcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagcctctggagttgacagcctctgagtggcagccactagagttgtctcggt

SEQ ID NO: 79519 - DNA, 4560 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaaatctgtctttcaggtttgccagaaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79520 - DNA, 3986 bp, Homo sapiens
  misc_feature (14)..(14): n is a, c, g, or t
atagcccgcggtantcggcacgaggcagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79521 - DNA, 3180 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79522 - DNA, 2198 bp, Homo sapiens
  misc_feature (45)..(45): n is a, c, g, or t
tccaatgtggggctgctcatcagcagaggtggctgagttgcggcnccgaatcatgttggacttactgctgggcttggagtcaaggtgtcccaaggtgggcatcatcaggcgctgagctggtgtgaaatcagttcttcccgtgccatgctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79523 - DNA, 2144 bp, Homo sapiens
ccgtgacgcccgcctctgccctctccacagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79524 - DNA, 2159 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacaggtgagagacccgggccctgcctgcctcactccctaggagccatgtctcacagggtgatgtctgtcagcagcaccgtctcctgtccctgccagcgcattgctccctgctccctggagttccatcctggctgtgtccagtccagctttcccctcccctattccacgccattgcctcctccccatcttcctctgactgctacttgcagtttgccaagtgtggggctgaccgtggccatctcagctaca

SEQ ID NO: 79525 - DNA, 1921 bp, Homo sapiens
ctgcgaaggcgccaaagcccagacctcgcgcctccgcccgcgacggcggcactgggggcccggagcgggcgggagacgtggattactgcgggcttcggggccctagcctcgaccgcgacgttcgctcgcatcgcgtacggacagaaacccgtgagcgctgaagaaagaacacctgaatccggagccccagcccccgtcgctcgtttgcgcgaccccaaaacctggcgggacgagggtcgcccgatgtctagctgccgccacagacgacgcttttgcgtctgcgcagcgcgccgccttgtgggtaatctcagggtgaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79526 - DNA, 1815 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagaccggccagggggctggcagcaccctcggccgatcagcccggctctca

SEQ ID NO: 79527 - DNA, 1566 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctgaaggccggggtttcagggtgatggtgtcgccttccagctcggagctcttgtagcccagg

SEQ ID NO: 79528 - DNA, 888 bp, Homo sapiens
ggccacctgagaggagggggcgacagtgtcaggaagaaaaggcaaggctgagagatgagagtggtgagggaagtcactgctatggagagagctggtgcccagattaatgccaatgaaggggaagccatggggagaggaagggcgagggggctgtgctttcagacaaaggctcccccatcacagagtgcccagtggccctgctctggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79529 - DNA, 413 bp, Homo sapiens
tctccagagaggttacaggttctgtggggacttgggtaacacaactaagtttcagtcctggttcagccacttattagtagtgtggctatgggcaagccacttcccttccctcgcctctgtggaatgggggcttgctgggttgttggccagccctgtaggaaatgagcatgcgtggggctggcactcagtggaccccttggccttacccattcccatcctccctctggcccagcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccac

SEQ ID NO: 79530 - DNA, 771 bp, Homo sapiens
  misc_feature (770)..(770): n is a, c, g, or t
cccacacagctggtgccttcttcaccagttcaataaaaggagattcaaaagtcagatgacactttcacaccacacatcacaaagaccagaatcaaggaagaagaaaatggtcatccttctcactcttccctcactcacagtggcctcggaaaacatggtccctagtctcacagttcatgggtcaatcaggaaaagcgactgatctgctctgagatgctcaaaggaaaatctgggtcctcaccatcatcaggcgctgagctggtgtgaaatcagttcttcccgtgccatgctcctgggcttttctcccactataaataactccagccttctgacagaccacatgatctctccaacgctggacaatattcccaacactagtgttcctctgcccacccatcaaaaaagaggcaagactgagcccactgtaaccaggagcaacaaagcaggcagacacgttggtgtcaggggcaaggacagaactcagcaaagccaggagggcttggctctctggctctggtccccactccaggaagccagacgatttcctcagcagtgcatcctccctgtggtttcctctccgagttcttaacacaatccagcaatggtgtaaattttctccctcatcttctcatcctgaaaaagcacttctctgtagtcattaccacacctacttaagatactggttaagacttgtgacttacacagccaaagaatcagatagactgatatcagacttacaaatcaatatggacacacttcctaagggtaana

SEQ ID NO: 79531 - DNA, 4296 bp, Homo sapiens
tcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagtggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79532 - DNA, 4236 bp, Homo sapiens
tcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcggcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79533 - DNA, 4219 bp, Homo sapiens
cataagatagaggcccggggtgtacaagtcatctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaaatctgtctttcaggtttgccagaaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79534 - DNA, 4220 bp, Homo sapiens
ttaggctaggtgcgaggctgggtggttgccagtctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaaatctgtctttcaggtttgccagaaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79535 - DNA, 4370 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79536 - DNA, 4532 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79537 - DNA, 4478 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79538 - DNA, 4439 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccggcgggccagctggacgggctgccggccgctgcgccgccccacctgggcgagactgcagcgatggattggtgtgtctcccctgctggcacttctcccctccctggcccttctcagttttctccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79539 - DNA, 4490 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccatcccacaaggtacagcgcagcgtgtcggccaatcccaagcagcggcgcttcagcgaccaggctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacgaacagcgtcctctccaccagcacaaatcgaagcaggaattccccacttttggagcgggccagcctcggccaggcctccatccagaatggcaaagacagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79540 - DNA, 2233 bp, Homo sapiens
atcttcagcaagttcacctccaagtttgtacgcaggaacctgaatgaacctgaaagcaaagaccgagtggagacgctcagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79541 - DNA, 2340 bp, Homo sapiens
cccacacagctggtgccttcttcaccagttcaataaaaggagattcaaaagtcagatgacactttcacaccacacatcacaaagaccagaatcaaggaagaagaaaatggtcatccttctcactcttccctcactcacagtggcctcggaaaacatggtccctagtctcacagttcatgggtcaatcaggaaaagcgactgatctgctctgagatgctcaaaggaaaatctgggtcctcaccatcatcaggcgctgagctggtgtgaaatcagttcttcccgtgccatgctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79542 - DNA, 2036 bp, Homo sapiens
tgaggatcccgagaggtgggacacggggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgaaaaaaatc

SEQ ID NO: 79543 - DNA, 1602 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagcaaatcatgaaagatcgatggatgaatgtgggtcacgaagatgatgaactaaagccttacgtggagccactccctgactacaaggacccccggcggacagagctgatggtgtccatgggttatacacgggaagagatccaggactcgctggtgggccagagatacaacgaggtgatggccacctatctgctcctgggctacaagagctccgagctggaaggcgacaccatcaccctgaaaccccggccttcagctgatctgaccaatagcagcgccccatccccgaagcagtgcacggggatcctctaggt

SEQ ID NO: 79544 - DNA, 1352 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcgggaacgggtactgaggggaaaataccgtattccattctacatgtccacggactgtgaaaacctgcttaagaaatttctcattcttaatcccagcaagagaggcactttagagttgagagttgcatgctgcaacctaatggtcagcaatgaaataaatacttgtagaatgttca

SEQ ID NO: 79545 - DNA, 795 bp, Homo sapiens
agggccggcggtggtggcggccatgttgggagcagcaggtccggcggcggctgcctgtgtgccgggcgcggagcagtgccgctgagggcaggggaggagcgaggcaggcggccggctgcggcggcagagagtaggcggagcggcgcggcccggccgaaaggcggcacagcccagccgggggtcgggggggtgcggtccggagccgctcggagccggcgcggcctagcccgagcggcgcatccccgggctggcgtgagcggctgcccggcctccccgcacccccggccggggcccatgcggcgggtgctcctgctgtgagaagccccgcccggccgggctccgcgccttcccttccctcccttcctccaagcttctcggttccctcccccgagataccggcgccatgtccagcgctcggacccccctacccacgctgaacgagagggacacggagcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtagctgtgaagatcattgacaagactcaactgaactcctccagcctccagaaactattccgcgactagcgtactccatgacaaggtagagcgttttctcagtctcaatcacttcaaataatttaactatgttgggatgattcaaaaccttcattatt

SEQ ID NO: 79546 - DNA, 362 bp, Homo sapiens
acctacagccaccactttcccatcctctgaaagaaaattttgttgagtttactttctataatttacattaagaaaaaattgaaatagtcaaaacaatactctaccctggagaaataaccctgcttcttctatctccttttgagatctactagtatactgaaaaaatgtaatctgtttaagaagtatagggtacaggataccaataagagtcagcagaaatggctaacatagtagcctttggctttcctgtcatttttgagtaggatataacctatcagatgaatctgaggaaattaaactagttttcagtatccactttgcactcacacaggacccaagttcatggttttagatacactgaa

SEQ ID NO: 79547 - DNA, 334 bp, Homo sapiens
tgcgttgatcttccagctttgagtgcagcacatttcacagccacatctagaaaatggaagaactacaggaataaatatgagcagattagtcagtgagctgcttgagacagctcagtatagcattttgtttggagttgctttttttggtcttgcttaattttgttataagcaatagttatttgcattttataaattttattccttaatcaaattatgtatggcttgtaatatgaaaaccagtgctatgggaaaaatgcgtgattagtggcagatactatgatatgtattgttctaattagaagtgttgtcactccctgagggtgattttaagtct

SEQ ID NO: 79548 - DNA, 771 bp, Homo sapiens
caccaccaccatcaccatcaccaccaccaccatcaccatcaccatcaccactgctctgtgactccttggctcccctcatactaaggtcttcaaccgtctgcagcccaaatcctcgcacaaagccaccacagaccagatagtcccagaaaaacaccttgcaacaacactccagtcaccagccgtacatgggactggtggaaacaggaaactggaaacaggaaacagaagtgccactttagtgagctgctgtgaggacaatatcagcaaatgcgcctaggacagtccagcgcagccgcccaggctggggtagtcaatgcacattcccctctcctctcccttccctcccgtgtctccatatgaagtacttagaggctttcccagtgttcctccaagcagggtgctcccaggagttcttgcctagcagagtggtgttgccaccaaacgcctccagccaatgaaaaggaagcagccaagtgtgtgaccacaacatccatcaccctagaaacattgcccccacttcccaacagccagtggtcaggagagggacagcaccctgggcaggcacctctgtggatttcatgagctgaaccacacaaaaccttggcagcaggacctggcccagagcaagagctcaagcattgttggctgctgctaggagagtttttatttttttttattgttattatttttttaagatggagtttcactcttattgcccaggctggagtgcagtagcatgatctcagctcactgcaaactccgcccccacac

SEQ ID NO: 79549 - DNA, 337 bp, Homo sapiens
ctgcaacttataccttccatttactaaagtcccagtatgtgtcaaagtagttttcattcctcacagccatgttatgagctaaatatcactaactttccctttcaaaggtgaaataaactgagactctcgaagattaacttgcccaaggtcacctagctcgttaggaggcacaggtgggacttgaacccagttctttctgaattcaaaacctccaaaatgtctgtcacatcaagctgcttcaatgagatgctagaaaatcaggacagtgagcaagctggagataaaggaagatatggaggaacacgggaagtgtgatcctcacacacagaccctgcag

SEQ ID NO: 79550 - DNA, 352 bp, Homo sapiens
tcaaacaaaagcgtgaacatgaatgtttaaagtggcattactcataatagccaaaaagtggaaatgacccaaatgtccatccactgaggaatggataaacaaactttgatatatgcatacagtagggtattatttagccataaaaatggataaaatactgatacatgtaacattgatgaaccttgaaaatatgctaagtgaaaggagccaatcacaaaagaccacatattgtatgatttaatttatatgaaatgtcccaaacaggcaaatctataaaggtagaaagcagattagtggttgtcaaggctgggggctcaggggcaataggcatggggtttcttttggggatgat

SEQ ID NO: 79551 - DNA, 114 bp, Homo sapiens
cgcgccattgcactccagcctgggcgacagagcgatactcagtttcaaagaaaaaaaaggtagtttcaaaattgtgaaaccaggcacagtggctcatgcctgtaatcgcagcag

SEQ ID NO: 79552 - DNA, 255 bp, Homo sapiens
tacaggcctggtttccccagtcctccaggagtatgctggaagcctgaacctgcatcttaatacttttttggtaatagaataaatgatatttcataaacatcctataatgtactaagatacaacaaaactgttgagtggtaaatactaacacaagagttgtgataggaatagtaccacagagaaaggccctctacagatccacccgaggcctgcagctttcaaacatttttttatcacaacctgcagtgaagtact

SEQ ID NO: 79553 - DNA, 825 bp, Homo sapiens
gaataggggaaaagttccatgactttttaaaaaatatatgttatatatgtttaagacacattttatgttttaaaactaccaatagtgaagaattgattctgatcttattaattctgtagtgttgttcatttattttaaaaatcttatttttcatttttttcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79554 - DNA, 448 bp, Homo sapiens
agttggctacagttttcatttttggtctccctttcttgacttggtgtatactcagtcctcattagtattgcagctatcatttgtcctgtcatgtgtctctgcagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79555 - DNA, 298 bp, Homo sapiens
ccccaaatgatagactgttgccaagctgcatctgttttttaattttttgttttgcccaatactcaaatgagtagacaaaataatagtttttatttggctgcattgcaaaacctaaatgtacattttacctagaaaaaaagcaagaccattgatttactaagtctggtagccgctatacggtagatttcataagaaacactattctattgccagagcaggagaattgcttgaacctgggaggcagaggttgcagtgagccgagatcttgccactgcactccagcctgggtgacagagcg

SEQ ID NO: 79556 - DNA, 2360 bp, Homo sapiens
gaacgccaggctggtacggtctgggatgtttgggcatcgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacagcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79557 - DNA, 2362 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79558 - DNA, 2656 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacagttttcgtctcctcggataatcaaccatttccatactcatgtaatctaggcatactctggagttattacaggtttggttccagaccactacaataaaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79559 - DNA, 2411 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtaatcacatgacatctgtagaatgatgttcagtaagttttaatacgtggctttgttaaacttgtcatttatgtccttttccctttctaaaccttgctcattggaaagcatccacttcacaaaaacaagaggatctattacagattcaaattgtttattacagtcctcactgaaaatacccatttacctaatttatgaaaaagactgctgtttttgaaggcaggcatttgcatcaaagtacaaataatctaaattgtctttttatgat

SEQ ID NO: 79560 - DNA, 702 bp, Homo sapiens
gaacgtgatataccctggtaggggcctattagcatgggcgattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79561 - DNA, 1674 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactggcaccaaattgattcttatcaactgttggccccaatttgaactggaacgtgcccggttttcctcaaccaaacgtgttgccgcgcaggggcaaagttttcggggcggtgttcccgggaac

SEQ ID NO: 79562 - DNA, 650 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatgggagtagctgggactacgggtgccgatcaccaggcccagctaattctcgcccggtattaactagtagaaatggggttacactggtgttagccaggacgtgtctcaaagctcctgagctcatgatccggccgaccttgagccttgactgggattacaggcagtgagctacgcatgcacggccagtctggatcatccttgaggagcctaccgc

SEQ ID NO: 79563 - DNA, 480 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggtggtatgtgttaaaaattggaagccacgtcttacgtttat

SEQ ID NO: 79564 - DNA, 272 bp, Homo sapiens
atggtttttttgtgttttttttcctgagaattgtcctgttgccacatggtaccttagtaggttttttatttttcctaagagttgttcacagtagaaaatacttagataaaaagagcagatggttttctgaacatattgttttccccactcagcaggaactgggggtttattctcttcctagattgttggactgcccaccaacattgacttcttactcaacctgtctggccacccagagtttgaagctgggaacgtgcacactgatttcatcc

SEQ ID NO: 79565 - DNA, 482 bp, Homo sapiens
tagtacggaaactgaaagagtggaggggaggggaatgctaagggcagaaatgaggggaatgtgagagggtggagggagattgtgttgactttgaaaatgagaagggaaaagaagattcagaagaagataggacagggaaagccagcttgtgtgccattgaatcaccacgttagggcctggtgctgttgggtggcccacctcgttacacctggtgagttttcaaagccctctgaacctcagggtcctcatgaataaatttgtgttgttatttatcatgcaggggtttatgaggattaagcgtgaaatgtacataacaaaatgtcttgctcgttgtattttattccttcgtgttttgacttgaagaggttaccgtggttttcaatttcaggagacgaagtttccgtgcattatgaccccatgattgcgaagctggtcgtgtgggcagcagatcgccaggcggcattgacaaaactgaggtacag

SEQ ID NO: 79566 - DNA, 393 bp, Homo sapiens
tagagggagatgatttgtcggccccgccatgttcgtcttaagtcaccagtggagcatccagctggtaatgacaataatcggaggtcacctggagaaggaatgtcggggctggaaacagatttgagctggcagcatcaaaatgatcattgaagtatcagaagcagacaaattgattttgacctgtatattctaccccacaaaactttaggttttcgtctcctcggataatcaaccatttccatactcatgtaatctaggcatactctggagttattacaggtttggttccagaccactacaataaagtgagtcaaagtttttggtttcctcatgcatataaaagttatgtttatattatactttattgtgtgccaataacattatgtctaaata

SEQ ID NO: 79567 - DNA, 2559 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79568 - DNA, 2153 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaataccgatgcgtcctggccttcaataattactctctctactcataaattagtctt

SEQ ID NO: 79569 - DNA, 877 bp, Homo sapiens
caacttcgaggatccccgctgtgcggaccatcctcaaggataaagccatgaccgacactttcactgttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaa

SEQ ID NO: 79570 - DNA, 1010 bp, Homo sapiens
gtagcgaggcttgggtggcgaactcggcacgaggcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacagaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaatgatatggtttggttctgtgtccccacccaaatctcatcttcaattgtaactctcacaattctcatgtatcgtgggaggaacccagtgggaggtgattgaattatgggggcaggtctttcctgcgctgttctcatggtcatgaatgagtctcatgagagctgatggttttaaaaatgagtgtttccctgcacaagctctctctttgcctgccaccatccatgtaagacatgaattcctcctccctgccttccgccatgattgcgaggcctccccagccatgtggaactgtgagtccaataaacttctttcttt

SEQ ID NO: 79571 - DNA, 311 bp, Homo sapiens
ggccctccggcagctccagagcacctcctgggtcaccacagagctaagccaggcctggtcactcctctgggcactaaggtctgaagctgggccacttgtctctgctcaaagttccctaggtaccccaccaagccaactctccccttcctcctggccgcagtgctgtcaaggtggctacagggaaagcagagggttttagcaactgcctaaagccataggtctccttccagttttcctgtctccaacctcggcaccagggagggcttcttcacgccttatgtgctttggaccccttctctgaacagtgtttt

SEQ ID NO: 79572 - DNA, 886 bp, Homo sapiens
tcccagagtgctggcattacaggcatgagccaccatgcccagccaattttctgttttagaaatacttttttgattactgaatagcttttgttgaacacagttgagaattaggttgtctattgttgccattctctatattgatgtttctggatatggtatgacattgttatttagagtatgttctaattcaaatatacttatttctaatcaacaggattatattttgtccgagtatattttgtctcttttttcatttatattttcacgtgtttgtgattttgaaaataacataattcaaacatttttctttaacctcagaacatatacttctttgttatccccccatttccacatataccctctttctagaacaaggaggaggacagatgtgggtttgggttttggggttttttttttaatactccttaatacttttttaaaaaatactcctttttaatactccttaaagttagctctaaatcccttgacattctgagcagtgtgtatagcaaaacttagctcttctagggggcagcatgaatgacttgctaagtcctaagggaaaaactgaaacatttaatctgtctttaaatcacttctgtttgtttgatcactctgagtgttatttacaaaattgcctttattagtgacaaataattaaattatataaaactaaacattcagttccttagacacactagctacatttcagatggtcagtaaccaccataccaaaaagaacagatgaagaatatttcctttatctcagaaagttctattagaaagtcctattctagactctaatgatggtaaaattgatcatatgagcagaagctcagactctgaaacctcatttgacaatatcctgaatgaattttctcagaaa

SEQ ID NO: 79573 - DNA, 863 bp, Homo sapiens
tcccagagtgctggcattacaggcatgagccaccatgcccagccaattttctgttttagaaatacttttttgattactgaatagcttttgttgaacacagttgagaattaggttgtctattgttgccattctctatattgatgtttctggatatggtatgacattgttatttagagtatgttctaattcaaatatacttatttctaatcaacaggattatattttgtccgagtatattttgtctcttttttcatttatattttcacgtgtttgtgattttgaaaataacataattcaaacatttttctttaacctcagaacatatacttctttgttatccccccatttccacatataccctctttctagaacaaggaggaggacagatgtgggtttgggttttggggttttttttttaatactccttaatacttttttaaaaaatactcctttttaatactccttaaagttagctctaaatcccttgacattctgagcagtgtgtatagcaaaacttagctcttctagggggcagcatgaatgacttgctaagtcctaagggaaaaactgaaacatttaatctgtctttaaatcacttctgtttgtttgatcactctgagtgttatttacaaaattgcctttattagtgacaaataattaaattgacataggaacattttctggaaattagagtgattggattttctttagaaatctccaaattggtggctgggcaaggtggcttacgcctgtattcccaccactttgggaggccgaggcaggcagatcacgaggtcaggcgttcgagaccagcctgactagcatggtgaaaccccgtctctactaaatatacaaaaaaaaaa

SEQ ID NO: 79574 - DNA, 455 bp, Homo sapiens
aaggaaaaaaaaaacctatttgaggtgatagcggctctaacaagaggtagatagatgggaggggtttgtgcctgacatcacaccatgagcaggggctgggggtgttccttcatctttaggacccaacatgtttcagtgtcacctgtacatcctgggcaactttgaggaagcttcctctctgtgacatacttagcagctaaacaggtttatgttttccatataaaactccctgagtcattaaaattttggagttccctgaggagcacagcaagttggcctgggggtgaaaaggaaagtccttttgttttgaaccagtggtctgggattaaagagactctgggagggttcatttggtgaagcaggagagagactgctctggttagaaactgctgatcagtttgaacactttgtcagttgtcatagtttcatgtttacttgccgtgaagtgctgcaaa

SEQ ID NO: 79575 - DNA, 892 bp, Homo sapiens
  misc_feature (440)..(440): n is a, c, g, or t
tttattccccctgcctacaaatgcattgcctgtggttgggtatgctgccaccaagtggttatagccaaagacccaggctgcagctaccaggaagtaagagcccttgtaaacttttaacaaagtgaaatcttgtaacagccttgtcttgcccacaaagggaaaatctgaagttgttttgtctctgctcttacacatgtctgcatatcaccaccaccaccaccaccaccaccaccaccattagctctgcctctgggccggtcactgagagtgcagtggcgcgatctcggctcactgcaacctctgcttcctgggttcaggcaatactgagatgagtattttaatgcatcatgccatttggttcttagaactaccctcagggaggtgatgcaatgagccccattttccagacaaggaaacagaggctgggaggtcaagtgacntcccaaggtcacagagagagacagtggctgggctaggatttgaccccaagtctacctgacatcaaagccatgacaaaagtctcccacttgggcacctgggtgtatgtctgggattggtgtgtgtcggtgtggatggcgggagttgggtagacagggtggtggggtaccaaggaatggtctggagcatggaatttcagaggaatcagaagtagagaccctcatggtgaggacctgcattctgggaagctgctgacagttcagagcccaaagaggaggtcagaggaatcctggggttgatcctctttctagcttcagggcgtctggtgacatctgggcacgggagcaaggttggattctacccttagacggcaggtccgctgcgaaggaggagctgggcttggggtttgggagtgggtagtggggctcctctggacttcagtgggacagggagg

SEQ ID NO: 79576 - DNA, 546 bp, Homo sapiens
cgagccaccactcccagccaggttgctattaaattttacctttttatccaggagcgtgggtcatcatttctttcaaataatgcttctatttatgagatttttctttgtagaaaatgtgggaaatgttaagagtataaggaagaaaataagtcgtgttaacgcaattgctgcatttttctttttttctttgcatatttcttttaaacttgagatcatgtaatgtcaacaagtttattggatttttctcctaatgtagtattagtatttccatgtgttgtaaagagcaagcttttaggtatcatttttaatgcaatataatgttgtaacatcctattgcaatgacagcttgtctttctcccaattttatctgcactattaggtattaagaatatttaatgtggccgggcatgaaggctcctgcctgtggtcccagcactttggcctcccgaggtgttgggattacagacacgagccaccactcccagccagttgctattaaattttaccttttatccaggaccgtggagccatcatctgggatcctct

SEQ ID NO: 79577 - DNA, 679 bp, Homo sapiens
cgagccaccactcccagccaggttgctattaaattttacctttttatccaggagcgtgggtcatcatttctttcaaataatgcttctatttatgagatttttctttgtagaaaatgtgggaaatgttaagagtataaggaagaaaataagtcgtgttaacgcaattgctgcatttttctttttttctttgcatatttcttttaaacttgagatcatgtaatgtcaacaagtttattggatttttctcctaatgtagtattagtatttccatgtgttgtaaagagcaagcttttaggtatcatttttaatgcaatataatgttgtaacatcctattgcaatgacagcttgtctttctcccaattttatctgcactattaggtattaagaatatttaatgtggccgggcatgaaggctcctgcctgtggtcccagcactttgggaggccgaggtgggtggaacacttgaggtcaggagttcgagaccagcttgggcaacatggtgaaaccgcatctccactcaaaatacaaaaattagctgggtgtggtgatgcatgcctctaatcccagctactcggaaggctaaggctggaaaatcatttgaacccaggaggtggaggttgcagtgagtcgagatcatgcactgcacttcagcctgggtaacagagccaaacactagct

SEQ ID NO: 79578 - DNA, 1632 bp, Homo sapiens
gtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgcccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttgggggggggggtcttcgacattgccgaggctggtcttgaactcctggacttagacgatcctcctgcctcagcctcccaagcaactgggattcatcctttctattaattcattgtacttatttgcttatttgtgtgtattgagcatctgtaatgtgccagcattgtgcccaggctagggggctatagaaacatctagaaatagactgaaagaaaatctgagttatggtaatacgtgaggaatttaaagactcatccccagcctctacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctccctctggaga

SEQ ID NO: 79579 - DNA, 756 bp, Homo sapiens
  misc_feature (58)..(58): n is a, c, g, or t
  misc_feature (71)..(71): n is a, c, g, or t
ggggtcccccccccccccccccccctccccccccccccctcccccccccccccccccnagttggcccttgntatttttttttatctttttaaaaaataatatattatatatattatatatatatatatatttctatttaaagaggatcctgagtttgtgaatggacttttttagaggagttgttttgggggggggggtcttcgacattgccgaggctggtcttgaactcctggacttagacgatcctcctgcctcagcctcccaagcaactgggattcatcctttctattaattcattgtacttatttgcttatttgtgtgtattgagcatctgtaatgtgccagcattgtgcccaggctagggggctatagaaacatctagaaatagactgaaagaaaatctgagttatggtaatacgtgaggaatttaaagactcatccccagcctctacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctccctctggaga

SEQ ID NO: 79580 - DNA, 769 bp, Homo sapiens
acgattctgccttattttctttctttcttttttctgagacagggtcttgctgtgccaaccaggctggagtacagtggcacaatcacagctcactgctgcctcaacctcctgggctcaagcaatcctcccacttcagcttccagagtagctgggaccacaggcatgtgccaccatacccagataatttttattttttcatagagatagggttttaccacattgccgaggctggtcttgaactcctggacttagacgatcctcctgcctcagcctcccaagcaactgggattcatcctttctattaattcattgtacttatttgcttatttgtgtgtattgagcatctgtaatgtgccagcattgtgcccaggctagggggctatagaaacatctagaaatagactgaaagaaaatctgagttatggtaatacgtgaggaatttaaagactcatccccagcctctacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcctccctctggaga

SEQ ID NO: 79581 - DNA, 715 bp, Homo sapiens
ctgaatagtatttttgtcttctgtatgactttattctactaggatttttgcgggggagcggtgtcctagtccattttgtgttgctataactgaataccatagactgggtgacttataaagaatggagatttatttagctcattgttctggaggctgggaagtcctagagcatggtaccagcatcttgtaagggccttcctgctgtgttgtgacatgatgggaggcatcacacggtaagacagagcaactgtgctagctctgtgtaactatacaattacatgtctacaaataattttttgttcaaatcttcttttctaatattgataacactccatacccactggcctaaactaataatgtcaataatgggcatttttgttgtatgtgtgtgtatattctgttctgtaacccttttatagctcaatacatgaggatgttttctactataagtattagtttctagtatcaattttattggccttgtactattccacaggatgtgtgtcactatatcacctagagaggggggagtatcccctctttgtcatttactcagggggccacaggagactattggggatggtgtcttccactgttgaaggagagttggacttggagtgaggtatcttttctggtcccagctggctctttcattcattcatttttctacacaaatagttatcaggtactaggtacctaggtactgggggtgggg

SEQ ID NO: 79582 - DNA, 589 bp, Homo sapiens
accctgtttgggatagatatttgtgaactcctcttgagctgatctacctcaagtaaattatataatccaggctcccagaaggtcagttccatgggtctcctccttggtaaagaataactctcagtgaccatttccatcccatcaaattttaaaaacatttttattttggatattttcttcaaacaagatgtagttgaatttgagtattttgaattttaaatttacattttaaatctaaaatgcatgtttttaaagagagctaaatgttgtaaatatgacatttgaaattttgaaatgtttagctcaaacattgtagaaataggaaaattctctcacaatcccaccacataaaggtgcctctattatagatgatgcacagtcctcaatatcctatgcatattctctgccaaagtgggatcacacaatacatactattttgctggttcgttgttgttgttgatgttgttgttgttttgtcatttaacatacctaaacgtcttttcatgccggtacacaatattattccttttacagctgtaaacttttatctttttaaaacccaaagttagaatcattcaggtcacttcat

SEQ ID NO: 79583 - DNA, 591 bp, Homo sapiens
ctccaggaagccaagccgctgcggtgcgctttggctacctgggagggaaaggggaaggaaattctctctaccccccggctttctcttcccttccccccatttgggaaacgagtagaggtattgaaatttaaaggagattttcaaaggccgctgtcgaaggatgctaataggagttgcaagacagacgcattaggaagagggaatttcccacggaaagctttgtaatgagctaacgagacgcgttcccccacctcacctttggaggggaggggaaaacagagcttgaattacgcatttaatttcccctgcgctcgttcccaaatgggaaaagctgatgggtctcgataggatcgggatttctggtttcaaggtttaacgttgtgcgcgctcccctgcttgcagaccccgcagctactcccaccgcacatcctctcgccggtcttcgcgtctgcgtctccctcccgctgttggcgcgttgcttcggctgcttttgcaccacaattgtgaagttcagaagttaccacagaatctatgtgatctgcagagaatcgcttgaacctgggaggcagaggttgcaggaggtggaggttg

SEQ ID NO: 79584 - DNA, 581 bp, Homo sapiens
cactaccactggggtaatgttccctgcgtcccaaaaccgggattcaggagctcttcctttgaagtcatgaatttataaaaggtgtttaataatcgttgctaccatacatattgttatgtatgaattgtgtcctccaaaatccatatgttgaggtcctaacccgcagcacctcagaaagtgatcttatttggaaacaaggcctttgcagatgtaattagtgaagtaaaggtgaggtcgttctggagctgagtagggttcctaatccaatatgaccggtgttcttttaagaagggaaaatttggccaggcacagtggctcacacctgtaatcccagcactttgggaggccgacgcaggcagatcacgaggtcaggagatcgagaccatcctggctaacatggtgaaaccccgtctctactaaaaatacaaaaaattacccaggcgtggtggcgggcgcctgtaatcccagctactcaggaggctgaggtaggagaacggcatgaacccgggaggtggagcttgaagtaagctgagattgcgccactgcactccagtctgggcgacggagcgagactccgtcta

SEQ ID NO: 79585 - DNA, 415 bp, Homo sapiens
gtttttcatttctccataattttctacaccctttatcagatatggcacatcagtagtcctctccaactaatgcatagcatatctctttttcatcatgtcatcaaagaactagaggttgaataaacatttgaacttcaatggctcgcttcttgcattgtaaagtaaccacttaggtgcaacttaaggttattctgtaacatttataaaccaacaagatgatgaaatgtcctgaggctgcaaaaagtagctgagagtaaactgcaagacagatctgttttaaaatacagggtcttccttccctttgacaaggagaagaaatgtcagctatctgtaagtctggctcttatggttgttaaaactgatgcggggatgaccaccaaatttatttcattaaaatcacctgaaacttctttta

SEQ ID NO: 79586 - DNA, 411 bp, Homo sapiens
ggctcaccgcaacctctgcctcccaggttcaagcaattatcctgcctcagcctcccgagtagctggactgcatgctaccacacccagccaatttttttttatttttagtagagacagggtttcactacattggccaggctggtgttgaactcctgacttaggtgatccgcctgcctcggcctctcacagtgctgggattacaggcgtaagacacagtgctcagccccaaatgggaaatggatccatctatatcaatatggagaacactcccaataaacctaccaggaaaaaaaaaattcacctaattctttaagtaaacaatctacagcaaaagtaacaacaaactctggcccagacattattttaaggcttaaatttataatttttctatgtctaattctccttacagga

SEQ ID NO: 79587 - DNA, 452 bp, Homo sapiens
cttacagataagaattaagacgtatgatagacatgagaagtctgcattttatgaggttagctagagaaaataaattttttggtccctgaaaagtgatcctgtttccagacaccagaaaaatgttcagagggccaactggctctgataactaaatctcatcatgaagagaaaggaactaaagaattgtggggtaaggaatggaatctaggacttaaaaaaataaggtttgaagtcgttaagaccctaaagttaatatgtgagtgttttttactggctggctttgaaggcattttgttgggctaaaaacccctgggcttcaattttctgaagcagattttgtcttcccatttagaaagtaaaaccctggcgattgattctctgggttccaggaggcctgtcctttcaagtgtccaatattgagttaaacaaaagtgtaaaatttgggtgaagat

SEQ ID NO: 79588 - DNA, 489 bp, Homo sapiens
tgctgacaaccaggtgtgattccctcacaatgtacaagcactgggcatttcagaggtgactttgtgctgtccttaccatgtagaggtaggcactgggcatctcaggggtgaccttgtgtttacaaccaggtgtgctgccctcatcatgcacaggtaggcgatgaacatctcagggtggaccccatcctgatcaccaggtgtgctctcctcactgtgcacaggttggggctggacatagcagggacccaggtgtgtgcaaggtgcagcgtttgttccatggggaggacctgcaggtcgtccagctccccattcctgtcctcagaaactcactggggcgcaatgcctgtagggcaaaaagctgcttgtgtgctgtgatgtgaacctcagggtgactccaaacgtgatcgtgctccatgttctgttaggctgctgtcaataaatgcaataaatgtgtgaacaattcctcgtagatgtctttggatattttta

SEQ ID NO: 79589 - DNA, 981 bp, Homo sapiens
tgccctggccaaggaggaggctgaaagagcctgagctgtgccctctccattccactgctgtggcagggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatggtgagaaaggcattcagacatggtgccactaggatcacagctttcattggcggccagtctcccagccccaaactgcagatacctggtcttcttcatggctgtggctcaatcttcctagatatttcattgaaaaacccaagagatatatctgtgcacatggcttttagccatgaggcttggaaactggacaccactgtaaagaacatctagtgtccgtaaatccataccaaagctctgaatccacaaaccaggctctggcccaaccctgcaaacacactcccattgctccatcttcagtaaaggaagacaaattcatttttctaataactgtggacctgcagcccccttagatgtgttgagagtctttggaaatattttcctctgaggtctgtccacagcttccctgggcctgcgctcagctggcccgagaaagaccaaggtccctcacatttgcatgtaaacagggagtgccctctgcccttccagtgagccctgccagcgtgggggaggcttcagctctgtgatccgttccagctcactctgaattacactcctacatgcccagtcacagactttttgcaatttcattttatttcactggcccaacatcattgttaaaataaaatttagttgtgttcc

SEQ ID NO: 79590 - DNA, 5689 bp, Homo sapiens
tgccctggccaaggaggaggctgaaagagcctgagctgtgccctctccattccactgctgtggcagggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctccagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctctataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagcctccagctaaagggaagaaaaaaaaaaaaaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaacgaggatggcaaagaaaaagaagaggaaaatacggatgcaaatgcagatgctggctcaagaaagggggatgaggagaacgagcataaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgc

SEQ ID NO: 79591 - DNA, 4056 bp, Homo sapiens
ctgatatacaaccaatactattattttgcagtaattgttgaccctttcactgaactgaaaaacattattaacctagtccagatagagggaatctgatggcatcggtctaattagagcctgaaaaaccaaaagagcactgaatccaaaattatacttgccaccttctactactgttccttttctagctgggcctcattcaaattctgcaggtgctgcaactggtatttcctgagcggcctgctttaccatcgctgtgccgtcctggccttgctgagggtccaccatacaccgagacactgttctttattccagaaacctgcccccagttataggagagagagggtggccatcggctagtgtgcatgggttgttaaactagtgaatcccttctgtgtgggctgacagatagccactgccccatcctaccacagagatccccaagacctctgcaactgaaggggtaccacctggcatggcaaccctccatcccagtgtggtaccacagacagctgtgccattgggaaggctctgcgcacgcctgtgcatgctgcttgctaaatatcttccattttactctgtggaagtctccccttaagcagcagtgattttgaaaggataatatctcaagtaggggaaaacctggtctaactttcccctaatttctcatgtctaagttgcaaaggaattttgccaaatcaaaacatttcctagtggtattctgccatctccactgggtggactgcccctctgtggggccacgtggggctcatctatgctctagagttttcatcctgtgtgactctggaatgtggagtaacaggcacgtgtccagataattaaaaaagaaatcaaaatgcagctgctttaattacagccagaaggacataatttagaaggcatttcctgagtttgtaaaaccctgaatctaagaatagggaggattccgtggaatttccctttctagatatctctccctgcctgagaagaagagtgtttaaacgttttgagtaggaaaggggccagatgacctggaatgttccatcagtcttattgttccaagattctaagacaagacttctaatacggcatctcagtttattgttctttggggtttgttttcagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgc

SEQ ID NO: 79592 - DNA, 4316 bp, Homo sapiens
cctaaaacattttctctagccccttttgcatgtttcctgttaatttctggttcagctacgtctggcaaacgagtgttatttttgctacatttgaagacctccctgaggaaataaactgtagaccttccctcttccatgatgttatttgtgtttagttttgggggaggttttgcttgtttgttttagttttgcagcgtcgcctcagttaaaggcttctaagtaaaactgctgacccaggggtgcaagttatccaaacagtatgccttctcagttcatttggttttagatagtttacttatcataataaacgtgtgcatcttttcaaaagaattcatatgcggagtggaaatgtaagatgtacttcagaagtctctttattacctctgacagaaagggttccctttctccaggagttctggaactctttgttgcatacttttatggcaaaaccatgaaatccatgtttctcccctcaggatgatgagcctccagctaaagggaagaaaaaaaaaaaaaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaacgaggatggcaaagaaaaagaagaggaaaatacggatgcaaatgcagatgctggctcaagaaagggggatgaggagaacgagcataaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgc

SEQ ID NO: 79593 - DNA, 3795 bp, Homo sapiens
cctaaaacattttctctagccccttttgcatgtttcctgttaatttctggttcagctacgtctggcaaacgagtgttatttttgctacatttgaagacctccctgaggaaataaactgtagaccttccctcttccatgatgttatttgtgtttagttttgggggaggttttgcttgtttgttttagttttgcagcgtcgcctcagttaaaggcttctaagtaaaactgctgacccaggggtgcaagttatccaaacagtatgccttctcagttcatttggttttagatagtttacttatcataataaacgtgtgcatcttttcaaaagaattcatatgcggagtggaaatgtaagatgtacttcagaagtctctttattacctctgacagaaagggttccctttctccaggagttctggaactctttgttgcatacttttatggcaaaaccatgaaatccatgtttctcccctcaggatgatgacaatatgtctccatgtagaaaatgaaaagtcagggcccatatcgtgctgaagtataaaatgcctcccgtcctgcctccaggtcttctgtctgcactggtgaggtgcagtgaaggtttcctctcaatgagtcagtccagttggaaacaaagattcttttagatgtgtcaacctgaaagaaaacagcgtttcaaaatttgattgctatgtgattcccccaaacacggctaacagcttgtctttctttcagatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgc

SEQ ID NO: 79594 - DNA, 2798 bp, Homo sapiens
ctttcttcgtcctaattaagcactcgtgaagtgcttaattggagacagcaatataatgagccagggtgaacttggcccacaagccaagacagtgagagacaaatgttctccttactcagatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagaccgtaagagtagaattcatactccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgc

SEQ ID NO: 79595 - DNA, 2369 bp, Homo sapiens
ctgatatacaaccaatactattattttgcagtaattgttgaccctttcactgaactgaaaaacattattaacctagtccagatagagggaatctgatggcatcggtctaattagagcctgaaaaaccaaaagagcactgaatccaaaattatacttgccaccttctactactgttccttttctagctgggcctcattcaaattctgcaggtgctgcaactggtatttcctgagcggcctgctttaccatcgctgtgccgtcctggccttgctgagggtccaccatacaccgagacactgttctttattccagaaacctgcccccagttataggagagagagggtggccatcggctagtgtgcatgggttgttaaactagtgaatcccttctgtgtgggctgacagatagccactgccccatcctaccacagagatccccaagacctctgcaactgaaggggtaccacctggcatggcaaccctccatcccagtgtggtaccacagacagctgtgccattgggaaggctctgcgcacgcctgtgcatgctgcttgctaaatatcttccattttactctgtggaagtctccccttaagcagcagtgattttgaaaggataatatctcaagtaggggaaaacctggtctaactttcccctaatttctcatgtctaagttgcaaaggaattttgccaaatcaaaacatttcctagtggtattctgccatctccactgggtggactgcccctctgtggggccacgtggggctcatctatgctctagagttttcatcctgtgtgactctggaatgtggagtaacaggcacgtgtccagataattaaaaaagaaatcaaaatgcagctgctttaattacagccagaaggacataatttagaaggcatttcctgagtttgtaaaaccctgaatctaagaatagggaggattccgtggaatttccctttctagatatctctccctgcctgagaagaagagtgtttaaacgttttgagtaggaaaggggccagatgacctggaatgttccatcagtcttattgttccaagattctaagacaagacttctaatacggcatctcagtttattgttctttggggtttgttttcagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgagtatgtgcagggctcttcatttctaagttgggctgatttcaaaatagtgttcaaattggacatcctcacagaaatctcactcaactacttgctcgtgtgaaaagcaccacactcagtccaactgctgttcttttcaaaaggcttctcattttgtacccattttattctagtttcgttaatttgttagtaattaatattaggaaagccagctcatagagaccagaagttgagctaattctctaaaataactctactctgtaaatttctatataaattcaatgctcctttcaaaacgtcttaatttgttgcatctaaagaaaatgagaaaataatgctatacgtttgactctattcataaaaataagtgcaaaaagttttccaggaaatattacttggctttactttcccagtaaatgtaattttgttttttatgtttaaaagcgggccgttt

SEQ ID NO: 79596 - DNA, 1637 bp, Homo sapiens
tgccctggccaaggaggaggctgaaagagcctgagctgtgccctctccattccactgctgtggcagggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctccagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccggtgaaactgttttttttcgattcatatcattgatcttgactttgtacaagtgacctattagtatgttctcccttgtgacatggaattcaggaaattatgtggggtttctgatgatatgatatgtaatctattaggctcattagaagatgtcactgtttaacttcaaagaaccaacaagaagtaattccacattcaaaccagtactcctgaagaaattaatcaccaaatattttatcgttgctgatgaaagtgggtttttacctttttaaagaaaaagaagaagaaataaaatagcttattaaaatttaaag

SEQ ID NO: 79597 - DNA, 501 bp, Homo sapiens
tgccccatactgcccaagactgtgttaaaaactaaatacatcaggatgctctaagccactgaagagccatgtttgccagtcacattatactgggcttctctggttatacaaagggacacctaatgaagatattctgttgatataaaagcagtctcatggacagtaatctttctatatccttaggcagccacaatactgcctgtcaaatataattaccagcagaagaacagaaaactaacacttacctattaccttgttaacatgtccacaatgagccaatatgaaatgaacataataatggtgtcatttgtggggaaaagcctgagagacatggtttatagtgctcaccaaggtctgaatgtcagaaagaatattatgtgataagactattttaacatgcaaatataatgggccaggttttccgtttggtttcctgctatatccaccacatctagaatagtatttggtactcaataaatatctgttcacttaatgaattga

SEQ ID NO: 79598 - DNA, 206 bp, Homo sapiens
gtaaaaacagtgttttgctaggcttaatttgaccatgttgtaaaatttattgtataccttgaaagaatcatttatgaaagatactgaattagctaatatatactctgtcttatgtagtttttgattaacaatacactttttaaatcattagctcatttgattttgcaaagaagaacaggtaacctaagaggcagacagaacaggca

SEQ ID NO: 79599 - DNA, 714 bp, Homo sapiens
gagactgagggagggcaggagagtggaaaggcagagagagaccttggttctgaggcttatttctgagacattttaattaaaaatacccagcatgccaaagcaccatattttggggtatagctttttgaaccccaacatttaggacttacatacttatacatatatgtagcaactactgaaatatcctgctgctgaagacattaatacttcagacagtataatgagtactagatatttgtagtacgtacgtgtgtgtgtgtgtgtgtgtctgtgtgtatctttgtgtgtctgtatgtgtgtgtggactcttgaagtgggacacaaattggttccaataaactcagtttctatgtccattgactaacctactttatcttcctcatttcttttcttttttaaactctttgccatgttgttagtgttaagaaattttgctgctcatgatactgttgtaggctcaaaaatgtattgccaatcatgtgtacaaagaaaatttagctgctttactgtaacaaatctattttattttcagtaaaccacctattctgaggtggtgtagggaattacagttgccagttcatgttattttagtctcttctaattttaaatgtcacttttggatgattctgtttctctcaggtgaatcctgagtcagattttctgcttctcctgctgttctatccaatgtggcatcaggatatattaaagattggt

SEQ ID NO: 79600 - DNA, 1981 bp, Homo sapiens
ttctgcttatcatggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaatagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccagttgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaagacataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaggatgaactgatgaccattcgacttagagaagctgaaacacaagcagaaataagagaaataaaacaaaggatgatggaaatggaaacacagttggttgaatccgcagatgtggagcctgcatatatgaagggctgaccgtatactctctgctccttccagagtatctggcatgtgatgagctcgccacaaacatttagtgattcgagtaaggctctggttgatttacagtttctactttcctgacactctgttgctggtttgaataaaaatttcttcctg

SEQ ID NO: 79601 - DNA, 2701 bp, Homo sapiens
agcgtggtgcttttgggaactcgggacgggcgacccgtggagccaggagcggggccgaggcgctgagacgcggcggcgcgctgccggctggatgggaagttaatgtttacggcgaagtctactcaacgtttccaagacagggtcttgctctgttgcccagactgtagtgcagtggggtgatcatggcttactgcaaccttgacctcctgggctcaagcaatcctcccacctcagcctcctgagtagctgggattacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaataggcttgagtacagtggcgtgaccacggctcactgcagctttgacctccttggctcaggtgatccttcgacctctgcctcccaagtggctgggactacagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccagttgcaacaaggatatttgatatctttatgtctgagggtttagaaatagtgtttcgtgtaggattagcacttcttcagatgaatcaggcagaactgatgcaacttgacatggaagggatgttacaggtaagttcataatttattttctttttttttttttgagacagagtttagttctgttgcccaggctggagtgcagtggcgtgatcttggctcactgcaacctctgcctcccaggttcaagtgatcctcctaccgcttcagccttctgtgtagctggaattacaagcatgcaccactacacctggctaagttttgtatttttagtagaaacagggtttcatcatgttggccaggctggtcttgaactcctgacctgaagtgatccgcctgccttggcctcccaaaatgctgagattacaagcatgagccaccacgcccagcccataatttcttgaatgtctttggatttcactattaacagcactaagtcattcttatgttttttttttaattgtatcttagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaagagcttccttggcagatagattgatacagcataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaggatgaactgatgaccattcgacttagagaagctgaaacacaagcagaaataagagaaataaaacaaaggatgatggaaatggaaacacagttggttgaatccgcagatgtggagcctgcatatatgaagggctgaccgtatactctctgctccttccagagtatctggcatgtgatgagctcgccacaaacatttagtgattcgagtaaggctctggttgatttacagtttctactttcctgacactctgttgctggtttgaataaaaatttcttcctg

SEQ ID NO: 79602 - DNA, 565 bp, Homo sapiens
agcgtggtgcttttgggaactcgggacgggcgacccgtggagccaggagcggggccgaggcgctgagacgcggcggcgcgctgccggctggatgggaagttaatgtttacggcgaagtctactcaacgtttccaagacagggtcttgctctgttgcccagactgtagtgcagtggggtgatcatggcttactgcaaccttgacctcctgggctcaagcaatcctcccacctcagcctcctgagtagctgggattacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaataggtgagtgaggttgcttagcttttttctctccaattatacaaatccggccattcaacgcgggccattcaacgcctccg

SEQ ID NO: 79603 - DNA, 380 bp, Homo sapiens
gcttactaagactgaagagttcctataaccagtaattaaaaatgggccagcctcctataaaccagctgttaaactccaatagcatgggggaaaagctcatcttattccatgtaggtagagaagaagcctagaaacataaacagtgattccttaagatcagagcccattttttgttgttgttcatctctctattccagaacatgcctgaatagaacattaattcacatggaagagattcaaaatacataggttatatgaccttcttaaagaatatgtcccagcctggcgtgtaagcctgtaatcccagcactttgggaggccgaggcgggcggatcacgaggttaggagttcgagaccagcccagccaatatgatgaaacc

SEQ ID NO: 79604 - DNA, 184 bp, Homo sapiens
tttttgtatttttagtagagacgggggtttcaccttgttagccaggatggtctcgatctcctgacctcatgatccacccgcctcggcctcccaaagtgctgggattacaggcgtgagccaccgcgcccggccttctttagttctttcaacatgtttataagagccaatttaaaatctttgttta

SEQ ID NO: 79605 - DNA, 390 bp, Homo sapiens
ctatgatcccattatatgaaatgtccagcatgggcaaatccttagggacagaaggtagactagtggttgtcagggcctgggtgagagggactgggggagtggagtgatggccaacatatacagggttacatgttttaggaggtgatgtacatgttctgaaattgattatggtgatagttacacaactctgtgaatatactaaaaaccatgaattgtacacttttttttttgttcttgttttttaaaaaatacagaatgcttcacaaatgtatatgtcatccttgcgcaggggccatgctaatcttctttgtatcattccaattttagtatatatgctgctgaagtgagcacaaattgtatattttaaactgtacactttagaaagttaaa

SEQ ID NO: 79606 - DNA, 400 bp, Homo sapiens
caaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgt

SEQ ID NO: 79607 - DNA, 463 bp, Homo sapiens
cgttgatctaaggatcccttgggctcattcaggggatggtggggtccagttttggggtctttgtctgtgaccctccaggggttctctggccagcagggctgctgtgggagtgaagaagggggtccttcaggggctcagaggcttgctggatggagtcctcagcacggtgggctccagctggaaagtcaggtcctgtcacagcagctgggagagtaggaggaggaggaacaaaggcattatgggggtgcgggctggcacctgcagcttggggcccagaggccagaatgtggcggcctagaggggcagtcttcagggtggtctctgcagcttggaggccccctgggcagacttctgccatcgccttccctggtggcccccaggccatctgtgtgcagcccccaggctcctcccgccctggcccagtactctgacctgggcctccctggagtgggcggggagcctg

SEQ ID NO: 79608 - DNA, 268 bp, Homo sapiens
tacaatgtcttttataattaagtttcccacatgtccttgctagtttattatgacccatttttgaaccatgctagaaagatacttttttattaggtaactagtgcttcaataaagcaagattctaattaatcaccactagttgtgtataccaaatacacatcctttaagacaatacagttcttaaaagaagaaaaattataattattctaatatttatacaaatcatataacgatttcacagaaccaaacacttacaagtagaattcta

SEQ ID NO: 79609 - DNA, 421 bp, Homo sapiens
tgttgctaccttgtgctgagacttgtgctagatagtgaggataccaagaaaaataagcacagggattttgtggtgttcatctttatctcctcagcatctaagataatacacaatgcatagtgggctctcagtagtgtttggtgaactaataagcgaaagatgtaatcgccgctgtgaaagcactcactcactatgtggtgggggccaacagacaggtacagatgtgttcctggtgtggagaaagtgccaaggtggctcagcgaagaaaaaagaattcttgtggtgctatcaagcaaggcttcatttgagggaaaagtaggatttctgtaggtggaaaaagagaagacattgatttgaaactccctggttgttttataaacttcatattagctatgtccacagagcctccaaaaggatataa

SEQ ID NO: 79610 - DNA, 232 bp, Homo sapiens
tggatgtttgaaggttcttggaccaagtaccaatcccaccttggctcagaccaggtgggcctgtgggcagctgcagagtgctcctgtgtgcatatgtgtgcacatgtatgtatatgcagcccattactgccacgtgggaacatgtgcctagtgacaccaaaccttctgattttcagagaggcccaaaatatctacattttgatgtagagactggctcagcaaactttttaaa

SEQ ID NO: 79611 - DNA, 279 bp, Homo sapiens
accctgtggtgtgaccactactatgtaaacaagccagagctagactgttgtgacaagagacacatggccaagccatcccatggccccagctgagactggaccaactaccagacatgtgagtgaggccaccctagatcatccattcccagccaagccactagctgaccacagtgattgaatgaaccagctgagaccagaactgccacgccagtgcacaaaatcataagaaagtataaacatttattatttaagttactgagtttgggtgattggtcacac

SEQ ID NO: 79612 - DNA, 275 bp, Homo sapiens
agtacgcacagacacgtctgctgcatgcctaggtacgaggctgtctccaggagaagcacttgtttgattatttgagttgccaattgaatttgctgctttttttcatggcttgccattttcactgaaaagaatgactaatgaaaaacgatgattggttattagatttggatgtttggcagacattttctcaaaattgaactaagttggcctcttcacggaaaacaactggtatttgttgtgccaatgataaaattggagatttctagcaaaatgta

SEQ ID NO: 79613 - DNA, 429 bp, Homo sapiens
gtattgacagattactagaagctgagggtagcctggctagaacattaaaaactccttgaagaccagactaagggggaatctcacacatttccaagtgttactacaatgatctcaaccaggttctcatgatgaagttcagaaaaactccctgaggtttggcactaccaacttcaggacttacattaagctacagtaacccaaatagtgtgaagttggtgaaaagagaaaacacacacatatagatgcatggaaaagaatacggagcccagaagcaggcctacatacagtccactgatcttccatggaggtttagagacaatttaaaacagcaaagatagcctttccaactagtggtgctagaacagctggacaaccacatgcaaaaaaaataaataaatccaggtatgcatgttatataccctttataaa

SEQ ID NO: 79614 - DNA, 254 bp, Homo sapiens
tctgcatgagaatcctgtttttattttgctgatgaaaaggttataaagtaagttagtggcaataccagaattcaaagcctagtatatttggtcccagaatgttctttctgctatatcatgatgctttccatagtagtagtgattatattctctagccattccttctctaccttttaggaaagtaggattgactagatgtattagtccatttccatactgccatgaagaaatacccaagactagataatttattt

SEQ ID NO: 79615 - DNA, 625 bp, Homo sapiens
gaaaaatagctcttaaatgaacttttaaagatggaggaatggtaacatgagctatgtgtgaattacttggaatgtcttattctattttgttttttcccaacttagttttaattaacttgtgaaaggtttctgactccttagatttgaacaggtaaaaatgtcataaagacatgaatgaagacttgttgctagcaaaaatgaagtaaatttgccataaagcctgtactcgagtttggaagggctgaggtttcacaggtgtaacaccttgaagccctgaggagaggagtgggacgtttaccctcacccacagcaggggccaaaagggctcttcagtcttacattcaggtctttcatggccacttctgaaaaaagggcagaagcctaaaagcagtaatccaggagaaaatgcaattcactgtcagaaatttctaaaactgagacagaatatagatgaactgaactaggaagatgttaaatagaagaagtagtgatttgtttgtgtcccctcctgagcccacacaagggagattactcaggccctcttacaatttggggaaggggaaagaagacaaaagagagtgggtttcataccgtctcctttattactagacactgccctccctcc

SEQ ID NO: 79616 - DNA, 285 bp, Homo sapiens
acagaagaaaatctgggtttctgtcagggacgtgttaagtttaagatctctgtcagaccaatcatatagcaggtcttacacagacagttactgtgttaattaatgaatttatatgtttcatatcagggatacatatatgtattcattagtatagtgtacatatatagagccttatagttttaattcttaagttcctatcttggtgtaaaacagtctctcatactggtaactattgtgcatatttgctgtattttcttccgttttctctataaaattgagatcata

SEQ ID NO: 79617 - DNA, 361 bp, Homo sapiens
tctcagggtgaagttattgttcgtattttacaatagtatgataatttaagcttaaggaagataagagctttacaatcacctattagatcatttttgtttagatttcctttaaattgttatctacttagaaaaattattctaaagattatagttatagttcacaacataataaaagatacttttgccttccttataaaatgttattttcagggttaggaaattacctaaaaaaataagctttaatcatgatttatgttctgagactttggaagagggtctatattaatataaatatttagaagaaaaaaatgtatcatcttgaaaggccctgaatattttcatggtggtgtttcttttttac

SEQ ID NO: 79618 - DNA, 4472 bp, Homo sapiens
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggc

SEQ ID NO: 79619 - DNA, 2264 bp, Homo sapiens
cactgttggcctactggcataggtgcttctcgtatgtgaacaggtgtcattctacagatctgttatgtgttttcctgttgactcttaagagtccctgcatgtaaatctcaaagctgagcctggctcccagagtccaggctgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgtccaggaattcaacattaattccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttctaaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgttttccagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggc

SEQ ID NO: 79620 - DNA, 422 bp, Homo sapiens
atatcgtcgacccacgcgtccgaaaagtactcaatgaacacaattctacataaattttgacataccatctaatttataaaaatcaataaaaaaggttttggtaaaactttttcatgccagatgctgtttacaacaatgaacatgccaataaaacatttgttcattctaaaaaaaaaaaaaaaaaaaaaaaaaaaaaaaaaaaaaaaaaaaaaaaaaaaaaaaaaaaaaaaaaaaaaaaaaaaaaacccaaaaaaaaaaggaaaaaaaaaaaaaaaaaaactttttggcccccttggcccaagcaattttaaatttgggcaagttttttaaaggggcccgaatttgggtttaattggccaattccccttaaaggggggggttttacaattaaatggcccgtgtttaaaaaccgtttaattgga

SEQ ID NO: 79621 - DNA, 411 bp, Homo sapiens
ctatttctgtttgtggggtaaaaggaaaataacttttctaagcaagttaattttttaaatgaactcaaataaaatgttttattttacagcttagtgaaatcagtgggattcctttggatgatattgaatttgctaaggtaaagccctgagaatgttgcatctgtgtattgtgcatgataaacacagctagtggcatgatttattcattcattctttttctttttagggtagaggaacatttccctgtgatatttctgtccttgatattcatcaagatttagactggaatcctaaagtttctaccctgaatgtctggcctctttatatctgtgatgatggtgcggtcatattttataggatgagacagaagaattcatggactgacagatgcgcgaagcatgatctctatcg

SEQ ID NO: 79622 - DNA, 8339 bp, Homo sapiens
  misc_feature (6227)..(6227): n is a, c, g, or t
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggctgcttcaggtctaattcaaccataaatttaaatggttgaaattctgattaattgacaagttaagttgggaggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79623 - DNA, 8266 bp, Homo sapiens
  misc_feature (6154)..(6154): n is a, c, g, or t
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79624 - DNA, 4830 bp, Homo sapiens
  misc_feature (2718)..(2718): n is a, c, g, or t
cgtgtatgatgacaactcggtaatgctgcatactcccgagtgcgcggtggggaagccaaccttggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79625 - DNA, 4418 bp, Homo sapiens
  misc_feature (2306)..(2306): n is a, c, g, or t
ctggctgacctgaggacccgaccagcatcctaaccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79626 - DNA, 5057 bp, Homo sapiens
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattg

SEQ ID NO: 79627 - DNA, 8212 bp, Homo sapiens
  misc_feature (6154)..(6154): n is a, c, g, or t
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgtattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79628 - DNA, 8247 bp, Homo sapiens
  misc_feature (6135)..(6135): n is a, c, g, or t
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatgggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79629 - DNA, 4104 bp, Homo sapiens
  misc_feature (1992)..(1992): n is a, c, g, or t
gcggccgcccccggggagcccggcgggcgccggcgcgcccccccccacccccaccccacgtctcgtcgcgcgcgcgtccgcatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79630 - DNA, 5625 bp, Homo sapiens
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattct

SEQ ID NO: 79631 - DNA, 5880 bp, Homo sapiens
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctaaaaaaaaaaaaaaaaaaaaaaaaaaaaaaaaaaaaaaaaaaaaaaaaaaaaaaaaaaaaaaaaaaaaaaaaaaaaaacccaaaaaaaaaaggaaaaaaaaaaaaaaaaaaactttttggcccccttggcccaagcaattttaaatttgggcaagttttttaaaggggcccgaatttgggtttaattggccaattccccttaaaggggggggttttacaattaaatggcccgtgtttaaaaaccgtttaattgga

SEQ ID NO: 79632 - DNA, 5179 bp, Homo sapiens
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattggaaagttttctaatttattataactttctcctctcatggagatgctcaattgctaa

SEQ ID NO: 79633 - DNA, 3290 bp, Homo sapiens
  misc_feature (1178)..(1178): n is a, c, g, or t
ccccgggctgcaggaattcggcacgagcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctntttggttctgatacaggcctgcttacttgggatgtagggttagtaaatggggtttctgctttaaaggactgacttgctatcgcacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccctcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatcttaacaattctgtgtaatttttgaaaaacatcaacattttggtcactagtagtccaaaatcttataaggcccatatgtcctgaaaggcaaaactctgtgtatgtgccgatttaccagggagatagtaggacagtttttatgagggtttcaaaggagttcatggcccaaatgaagcttgtggcccacctaggtttagtgtacatgaaattggaagatgcttcttgattgtagttcccatggggaagagggaggctgtgatcatttggttagatacagcattaattgtcacaacttgactttcagaaacaagaatactgcacaaactcaagcatgcattggagcatgtgttactatttagaaaagagtgcagccatcagtaggtcaagctaggagggcaaaagagagttgagaggaatgctctgccccttccccatcacagcactgcccctttccacctcctcaccagctcacctgtacaagagaattgatctcaactgagtgtcagctcaccaggtcagaaattgttattggaccctaaaaccttgcctcacaggtgggcaccaagctccccttccctctgctttccatgtttcccacctgccctctccccacctgttttcagcctcttttataatgcttaagtaacctgcttgaagagtataatttatggagataaaaatactcaatgcttacatttttttcataactgtgccaattgttttgtcaaatgcagttacccactgggcagtgggcttatcaagtgctcagtgcaatcctgtgacttttaagtcattttgcattattaagacaatcttatcttaaagttcagtggtttc

SEQ ID NO: 79634 - DNA, 5115 bp, Homo sapiens
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgaacaaagaaagaaaaaactcaagggggggcccgggacccaaatccgcccttaagggaa

SEQ ID NO: 79635 - DNA, 5863 bp, Homo sapiens
  misc_feature (5059)..(5059): n is a, c, g, or t
  misc_feature (5731)..(5731): n is a, c, g, or t
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattganaaacttatcccacccctctacctcccttcatccccattttacactcttctctttcacctcccctcctacattcctctcactcactctacataatcctctccttctctctatatacctcccctctcttcttctcacactcctttatcatcttcctacttcttatactcactcctctcttcacttcctctcttcctctttatccttcactctcctactacatccatccttcttccactcatccactatctccatcatattatcctatcttcttctccctcctcccttaactcttctctttcccactatttctccttcttcacctcaacggctcctactctctccacactctctcacacttctcctcttctctctctcacttcctctccctctcttctcactttcttcccctcctctctaacctctcatcacctcatactatatcttccattctcatcttctcccaatactactcctataatctcactcctcctttctctctctcattctctatcctttctcctctctcacttcactctctactatttctctctctttctcactctctctatctactattctctctctcctcattctcttcctacttcactctactcactttctcactcttatctattacactctatacatcacactctctctacatcctactcntctctactttccaccttcttctctctccataccttatcctcactactctcttacttactattcactctcttctctcactctctctatctcacccttcttctctaacccctctcaccactttcctctcctctt

SEQ ID NO: 79636 - DNA, 5806 bp, Homo sapiens
  misc_feature (5002)..(5002): n is a, c, g, or t
  misc_feature (5674)..(5674): n is a, c, g, or t
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattganaaacttatcccacccctctacctcccttcatccccattttacactcttctctttcacctcccctcctacattcctctcactcactctacataatcctctccttctctctatatacctcccctctcttcttctcacactcctttatcatcttcctacttcttatactcactcctctcttcacttcctctcttcctctttatccttcactctcctactacatccatccttcttccactcatccactatctccatcatattatcctatcttcttctccctcctcccttaactcttctctttcccactatttctccttcttcacctcaacggctcctactctctccacactctctcacacttctcctcttctctctctcacttcctctccctctcttctcactttcttcccctcctctctaacctctcatcacctcatactatatcttccattctcatcttctcccaatactactcctataatctcactcctcctttctctctctcattctctatcctttctcctctctcacttcactctctactatttctctctctttctcactctctctatctactattctctctctcctcattctcttcctacttcactctactcactttctcactcttatctattacactctatacatcacactctctctacatcctactcntctctactttccaccttcttctctctccataccttatcctcactactctcttacttactattcactctcttctctcactctctctatctcacccttcttctctaacccctctcaccactttcctctcctctt

SEQ ID NO: 79637 - DNA, 5086 bp, Homo sapiens
acgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatatcccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggctcattctgggagcgctgctggtggtcattattatgcatgtataaagtcattcagtgatgagcagtggtacagcttcgatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtgggtgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaagatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgttgccacactacacacctccactcacccactcccctcctcttcctccttcttctctctcccttctcccctctccccccttccctcg

SEQ ID NO: 79638 - DNA, 554 bp, Homo sapiens
acatctcagtatataaaataatattacttcaccagtaacagatttcattatcttgctgaggagcatcatagcattcaagcatacattaatagaggtggagggctctactggactaatatgtgattaatattttatatgtagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaat

SEQ ID NO: 79639 - DNA, 502 bp, Homo sapiens
cagacgtaaccagtgcttgttgctggagtggtagcaacagcaaataaacacgtcggggcttgagagcagcaggtctgcagcacgccctccggacagcgtgctgggacgcacagtgggccccgggtctgtgggccaggcattcccatcagaggtcccagggctgatgctccttgccctggcaacctggtgacgcactgaggctggggcctgatgcaagcagaggtgtccagacctgccagggacaggccttccggctagggactgtggccaacaggcttctcagctgacttggctcagcccagggactctgggcgccaccaccaaccccaggcgtccccagaagtggggaggccacactcagtgctgcctgttctgtgagtcctccccacacctggtgagccccggctcagagacgtgccgcagccccagggctggccacgtgccacctcctccccacagttcccagcctgctctttaaacagccgcttcctgccccacgtgg

SEQ ID NO: 79640 - DNA, 835 bp, Homo sapiens
ccaagaacatttaaaaatatgtatttaatattaactctgctataatttccaagcaaactctttgatatcctttataagaaacacttctataatcacttaggaaatctgcataagtctattaaagactcctcagttgcactatgtttatttttgcaaaaacaaactttggctgaaccatttgttttcagcatgtaaagcaggaagcagctgttgctgttgctgttgtatactgagttcctttgaggatgtagagtgattctgcttttttaccttttaccaaatagttcagttgagcatgagtgattaaaaagtataccgaatcaaatatttgtgatgcttggactgtcaagcttctagagagcagagtttatatctggtcaggtccctgtggtatcccagtctctgacgcagcgtctgacacacagtccatgctcaaatccctgttaaaagcatgaatacttagaattaaagtatttattcaaaattatggcatgtgttaacattcgtcagaaagcaaaagacttttttaaatgtggaaaagatttttttctacttacattacatctatcaaagggctttcagatgggtctgtgcagttactagctggtagaaatgaaaacaaagattgtgattagctgttagtagtgtatatgccaatgtttatctaattctttcccttgtcttcttttccaaaaggaaattagatgttagcaggatggtctcagggccaagttcatgtttgttttctaactagtggcacaaccacaagcttccattcttctctatgttactgtaagaaagtggctaattaaaatgtgagggaagagtgtttccc

SEQ ID NO: 79641 - DNA, 674 bp, Homo sapiens
  misc_feature (641)..(641): n is a, c, g, or t
  misc_feature (646)..(646): n is a, c, g, or t
tggcctgcagagaggccccacaagcagtacaggtgatcctgatacgatttaaagtttaacaaccatgttgttttttattttttatttgagacggagtttcactcgttgtccaaggtagagtgcaatggcgcaatctcggctcaccacaacctctgcctgtgtgatggagcaagactccatcacaggagggggggaaaaacaacaaaaaaacaaaaaacactccccagctgatcccagtatgcagtcaatgtcatgcaccgctgctcagatccactctacacactgcttaaggcagagctctgcacataatgccctctgctcagaaacctcagtagctttcagttggtaatcaatttagaacttagagtagaatgcctaattcccatcctcatcctaggccagtgactctcaaaatgttggcagagaccagagatactggtgtcacctgttagatggtggcatctgttagaaatgcatgccaaggctccatccctactcaatcagaaactgggggagaggccccacaagcagtacaggtgatcctgatacgatttaaagtttaacaaccatgttgttttttattttttatttgagacggagtttcactcgttgtccgaggtctgccactgcaccactccagncctgnttgatggagcaagactccatcacaggag

SEQ ID NO: 79642 - DNA, 1012 bp, Homo sapiens
caaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagag

SEQ ID NO: 79643 - DNA, 818 bp, Homo sapiens
tatagccatgaaaggatcaccacaatcaagataatggacatacccatcaccgcccaaaaaatgcccctttagaatcttttcttcccacctctctccccaagcaaccactgttattatagtttccattttctagagttttatataaatggaatcatatcgtatgtactcttttatcagacttctatgactttttatttatttatttttagaaatgggttcttgctgtgttggccaggttggtcttgaacttctgagctcaagcagttctgccacttcagcctcccaaagtgctgggattacaggcatgagccactatgcctagtgtatcactattttaaatagtaaaaaagaattacaattattttcgttattttgagattcactcacgtcatgtgtatcaatatgatttattcctttttatcactgatagtatttcattgtatcgttataccactgtttgatttaatccattcacctgttgattgacatttgagtttcttttctttctggggctatcacaaataaaactatatgaacattcatgtctttgtatagacacccagtcatgtgtccgttaacgacccaggatacattctgagaaatgtgtcatgattttctcattgggcaaacatcatagactgatggtataacttactacacacccaggctatatgatatagcctattgctcctaggctacaaatctgtacagcatgttactatactgagtactgtagacagttgtaacacaacagtaagtgtttgtgtatctaaacctatctaaacaaaaagacacagtaaaaatgtggtatgaaagat

SEQ ID NO: 79644 - DNA, 542 bp, Homo sapiens
gagttcgagaccagcctagccaacatggtgaaaccctgtctctactgaaaattcaaaaaattagccaggcatggtggcacatgcctgtaatctcagctactggggaggctgaggcaggagaatcgcttgaacctgggaggcagaggttgcggtgagccaagatcatgccattgcactccagctgggtgaagaagcaagactccacctcaaaaaaaaaaaaaaaaaaaaaaaaaaagaatggctggaactcactgtgagaaatgcactttatggcaccccacataacacacatacatatttattataattgaaataaaatattctccaaaatacacttaaggtgcaaattaccctgatgttttctatgttatcctatcccatcccttgccactccactccactctaatatatttttgttacaaaaatgcgaattatgacctacctaaatgactttacaacctacaatttgaaaaacatttacttaattggtggatttctcggggctaatcctaaactcagaaaaggcatttgcaaaaaaaaaa

SEQ ID NO: 79645 - DNA, 631 bp, Homo sapiens
gtccaattaaacctctttcttttgtaaattgcccagtctggggtatgtgtttatcagcaggatgaaaatggactaatacaatcctcaattcatatggccaatttctgtgtcatgtgtcaaataagcagttttcacaggaaaatgtgtgtactggaagtattaccaaaactaatctcaggcttcaaatacccgcaaaaattgatggggctgagaagtctcactgctccactcctgtaatattatttaagatgaaaatacggtgtcagaaatactgtgtccacagcatttaatccttggcttttccaaaaatgtctgccaaaccagaactttctttttcaccttcaaagtgtcaaagacacttgggggtgggggggcaggggacagacacagtggctcatgcctgtaaccatagtgctttgggaggttgaggtgggaggatggcttgaggacaggagttcaagaccagcctgggcaaaacagtgagacacccacctctacaaaaaataaaaaaaattagctgggtgtggtggcgtatgtgtactcccagctacttgggaggctgaggtcagaggatcccttgagcccaggagtttgaggttatagcctgggcaacaaagtgagaccctaactc

SEQ ID NO: 79646 - DNA, 319 bp, Homo sapiens
ttctcatgtctgaatttcacacgcacaagtctgaaatgtgaaggtttcttaatgttggttttatggttcgtgtaagatttttgggaaatgaagggctcttcattaggataaaatggtcttaacttcccagagaagaatttcctgacaacgtggctgaagttagatacaaatgttaatatagaagaatgcttttatttgaatttctagcaaatggttttcaactactttaaatatgacctacttgaaagtattatttcttttttaaaactactttttatgtatagatctaagtctgcttgaagctagtagttaaagtgtt

SEQ ID NO: 79647 - DNA, 386 bp, Homo sapiens
gtgctgagaaagaaattaagaaatagaaataccttttctactctgtactctctgggactttattttcaaagtgttgagttctcttattctaatgtcactgaaaatgtagggattttttttgttcggggtccaactctttagggataaagtatccatccttattgttttcctagttcaaactcttgtttgttgtaaggaataaatggagaatatgccagaaggctttcaaactgttcatttctttgcacattagggttgcttttctctcaaataataacaactgctaccattttttcaagctgtatgtgccagaattgtgatgagcattttatatatgttatcacttctctacaacaaccctagaatttaggattattcttttcatt

SEQ ID NO: 79648 - DNA, 290 bp, Homo sapiens
gccgagattgcaccactgcactccaacctgggtgatagagcaaaaaaacaaaagaaagaagaagaatgtaatcccagctattcgggaggctgaggcaggaggattgcttgaacccacagtgaaacctcatctcaaaaaatttttaaaataatgggagaggccaggcgtggtggctcacgcctgtaatcccagcactttgggaggccgaggcagatggatcacctgaggttaggagttcgagaccagcctggccaacatggtgaaaccccatttctactaaaaaatacaaa

SEQ ID NO: 79649 - DNA, 306 bp, Homo sapiens
tggcagaggtggatgctgtgataatccctacaaataaaaggctcatagaaaaaggagtgcaaatcctttcatttactgaagagaaattgtgtctagaaagggtctatgtttagaaacagaaccatcaagaaattggtctgaaatatagggaatcactgtcttcactgattaactacataccagatattagtttacaaaatttcctaaccaagaaacataaactcttcatactatactcttagaatttgtgaaaggaattttcttgtttttgtggtttttttttaaattgtaaatcctatagtaggg

SEQ ID NO: 79650 - DNA, 416 bp, Homo sapiens
gtgttattttcagatttggtttcctatttgttttcctttgtgtaatagccggttttatccttggaccacttatccaattagaatctgacgttgtgctcacatttatataaattcttgtgtgggcacatgaattaagtctccaattgttgctgtgcatattttcccattttgttgctttcattacgttctagttctaaaaggttttaaacttcatatcaataaatatgtgcatctttgcccttttcaattttctcctccttcaaaaaaattttcttctttacagctgaaactgtgctactgcaaatctgtaattctttagttcattgggagttcactgtgatatattatatggcttgtggtctgaatcttgaatttttttcttttgaattatatcttgtattagtaactatttttac

SEQ ID NO: 79651 - DNA, 467 bp, Homo sapiens
tcctgtctcaaaaaaaaggaactcatttggtatagttgcactctaactgccttctaaagctttaaccccccaaaatggatgcatatgggagttttgtcatttgcaggcagagaggaagcatttctgtttctttaaatcatatcaagttgactcaaaccatagattcatgcatttattcattcaatcagtcagccaaccagcatttattgagtgcctactatgtaccaggcactttcctaggtactatataaaactcatcttgcatactatgaatgaatggcagcaaaacatgttataggttccacagctgcagagtgtagaaagatcaaatgtagcgctccttcctaaggttccaagggaagatacagagtcatcttcaagtagagcactctatgatatgcatacattactactggaaaggtacatttgttagcatctcagccatacctaggaaaatcttgtcagcc

SEQ ID NO: 79652 - DNA, 405 bp, Homo sapiens
gcaccactgcactccagcctggggcttgaggttttgccagatggtttggtagagttggagatgttagcaagaaagggattacaatgtaatcattacaatggatctaagccagtgagggagttcagaacaggggaggtgagccaaggtgagaaggtgttagggtgatgaatggatggaagaaagtgtgagctggatgctaggagggggtggttgcagggcacatacttggctttgggattgaagagagacatggttactaggaatgagcaggtgtagtgctgaccatggacgtgggagcctgagatgggttggatgacagggtctttggaggagaggaggtccgaaagctgagaggtatgagggtcccaaactgagggtatggatgttgaaccagcaagagttatg

SEQ ID NO: 79653 - DNA, 282 bp, Homo sapiens
gctttattctgatgaccctagaagctagtctatatcattagaactaaatcagtcttgtaccaagtaacagtttcaaatggcagtgggaaaactgagaggaggggaatgagaagagttcaggccacatctacaaagctccctgcagttgttttggggctgcatatctatagggtgaacaccacttgtttgcaaaagacaatttgttgcacaaacaacttaatagcagtaagaatgaaaataaaaattaaacatacagtttaaaataaaaaagttattgcacta

SEQ ID NO: 79654 - DNA, 413 bp, Homo sapiens
tgtgtcttggctctaccttccctgagtcctgcctgctcttgagtgttgtataactctttgtaacgtgaggcgggcagggtgtaggtagatgctgcatgctgttgaatgttgtggattctatgtgtgctttattttctggggaactagggtgtggtagtgctagctgggtatattggaggccactggcttaaaactgtctttcccatagagtctaatttctaagataattttgttgacaagtttctcttctgggatgaaaatatgtttaattaggttaaacgttggtcattgactagtggtggtggttatgatacttccatgaattcttagcttcagtaaccttcctgagtggggattttatttgggggacaaggagagattcctttcttcctttcattcttcccacctttttg

SEQ ID NO: 79655 - DNA, 234 bp, Homo sapiens
tactggcatctgattttcaaatttttaataattaaatatttacttgaatctaagatatcatcagttgaaaggagtccaatttcagaaatgttaaaatataaaaacacagcatcatcaagttgctaaaatgtgctaatttcacattatataataaacaagaatattctaattactaattttctagagagatttttcataaaatagttgagcatctgatagggcatatgaatccat

SEQ ID NO: 79656 - DNA, 859 bp, Homo sapiens
gcttccggttccggtagcagctagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagt

SEQ ID NO: 79657 - DNA, 595 bp, Homo sapiens
cccctttatacaaattaaatttcctggaacggttgtgaaaaggcctaagtaccaaacttgaaaaacgataaaaaaaatatttgtgaaaaagaaggctttatggcaaaagggtcattttaaacgagtagggaagcaaggcctcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactca

SEQ ID NO: 79658 - DNA, 923 bp, Homo sapiens
gcttccggttccggtagcagctagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactca

SEQ ID NO: 79659 - DNA, 1593 bp, Homo sapiens
gcttccggttccggtagcagctagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcattttaagacgagtaggcgaagcaaggactcaacacggaggtagtcacgtttcccggaaatccgaacacttgagtgtcagaccacagactgcgttggaagaaaacgagactcagaaagaagttccacaggaccagcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactcaatctgactaggcttgctttgatgtttgttagtatgtgggctggctacatctgattcccgggtacatatttcttctgatccatcagacttatacgtgtacacatgttgtggaaccttggctagctggttttgtctgcagagaatctttgtacttcttgctatagaacgattatctctccacttgagaggccaagctgacttgagctttgtggtaagagtgaggacctgtcattgctgatacacaaagaccaaaactgtaactttaatgtcatggattgagtgtgctggagacagttaacataggcctgcacagactaggctgttcagtaaatacttgttgaatgaatgagtgaacgaatggttatatccagctaaagactggattcatatggtgtagataacaggattgccaagaaaggaggcagctaatttaggtgatgctctccaccagcatccacctgcctccctggggccaaagtgtgcctacaagtccttatcaacttccctgccttcctcgtttccccaggttttactaaatacatgaaatatccctctgagattgcagcctttgtatatgtggtcaagccagtggtttttagctgttagtagtaagctgcttcagaaattccctattttaaaactcatgtagattttctacccagtgattcttt

SEQ ID NO: 79660 - DNA, 582 bp, Homo sapiens
tcataggagaaaaacaagggagagaaaaatctaaacccagcagaagagaaagtttaagaaagcggtcgtcgccaataccaaaattagctatgatattcaggaagaaaaaaatggaaacacgataaccacagtcaataaagaccaaggccacattccattgaccagagctcagccacgcgccacacctggctaaagagactctggctgaagaattccctgaatattttaatgtagctctaggttataacacagaacaaccacaaggtggcagaagaactccattcttgtaaatctcttagttgcttctttatttcatcttccctattccatctaatgttccctgaattttactattttgttggtttgaaaatatgtgtgacttacgtcctttaaaggatttggttcgtaaggttttgaatagactggaatataaaacatttatagaaaagaaaaatacctacagtatgatgttagtgaactattaataatccaattaaataaaatatatttgctttggattaatacatattctgttttgatgtttgctaaataaaactaagcattaggaggccaaatagccac

SEQ ID NO: 79661 - DNA, 521 bp, Homo sapiens
tcataggagaaaaacaagggagagaaaaatctaaacccagcagaagagaaagtttaagaaagcggtcgtcgccaataccaaaattagctatgatattcaggaagaaaaaaatggaaacacgataaccacagtcaataaagaccaaggccacattccattgaccagagctcagccacgcgccacacctggctaaagagactctggctgaagaattccctgaatattttaatgtagctctaggttataacacagaacaaccacaaggtggcagaagaactccattcttgtaaatctcttagttgcttctttatttcatcttccctattccatctaatgttccctgaattttactattttgttggtttgaaaatatgtgtgacttacgtcctttaaaggatttggttcgtaaggttttgaatagactggaatataaaacatttatagaaaagaaaaatacctacagtatgatgttagtgaactattaataatccaattaaataaaatatatttgctttggatta

SEQ ID NO: 79662 - DNA, 1543 bp, Homo sapiens
acacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctccttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccata

SEQ ID NO: 79663 - DNA, 533 bp, Homo sapiens
cctcagatatctttacaccaaacggaggaatgagggggggcccccccaacaagggggctttccttgccgttcaaattgccatgggaaagggaaaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccata

SEQ ID NO: 79664 - DNA, 2443 bp, Homo sapiens
acacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctccttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaccataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctccaagcaatggcaacagaacttggaacagaagcaagagagtgtcaccttcacttctggtagggtggttcccaggcgactgcaggtcctgtgaaagacaggggtctcaaagttctgttaatttcacaaatttgttataaatttgtctaaactgagctgttgtggcaacataatttatgaatcgtaaggtctagttaggcttattggggggatatctacatatatatgtgtatgtaagggaaaaaaaggtagaatttacagccttcaaaaaagaaaaatcaaattccaagcacaggaataagaaagctatatagcaactgctcagagaacagaaagttatcaggggaaatactgaataaatagacacacacata

SEQ ID NO: 79665 - DNA, 1900 bp, Homo sapiens
acacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctccttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaccataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatccta

SEQ ID NO: 79666 - DNA, 2415 bp, Homo sapiens
aagtgtttaccataaagggcagctgtgaggctgtgagatgggagaatcaatctatttattggtcagaaagtggttgttcagtaccttggatttctgagtgggcaaggctggaccctgagccctgggacctctgaagtgaacactgcagggccatttgttcttccagtgtgaatcagttaatattctcgggaacgagggagaggttgatcctatgaggaaatcaaccacagtgaaaaggcttgggccgcttttgttttcacctccttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaccataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctccaagcaatggcaacagaacttggaacagaagcaagagagtgtcaccttcacttctggtagggtggttcccaggcgactgcaggtcctgtgaaagacaggggtctcaaagttctgttaatttcacaaatttgttataaatttgtctaaactgagctgttgtggcaacataatttatgaatcgtaaggtctagttaggcttattggggggatatctacatatatatgtgtatgtaagggaaaaaaaggtagaatttacagccttcaaaaaagaaaaatcaaattccaagcacaggaataagaaagctatatagcaactgctcagagaacagaaagttatcaggggaaatactgaataaatagacacacacata

SEQ ID NO: 79667 - DNA, 2235 bp, Homo sapiens
aagtgtttaccataaagggcagctgtgaggctgtgagatgggagaatcaatctatttattggtcagaaagtggttgttcagtaccttggatttctgagtgggcaaggctggaccctgagccctgggacctctgaagtgaacactgcagggccatttgtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaccataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctccaagcaatggcaacagaacttggaacagaagcaagagagtgtcaccttcacttctggtagggtggttcccaggcgactgcaggtcctgtgaaagacaggggtctcaaagttctgttaatttcacaaatttgttataaatttgtctaaactgagctgttgtggcaacataatttatgaatcgtaaggtctagttaggcttattggggggatatctacatatatatgtgtatgtaagggaaaaaaaggtagaatttacagccttcaaaaaagaaaaatcaaattccaagcacaggaataagaaagctatatagcaactgctcagagaacagaaagttatcaggggaaatactgaataaatagacacacacata

SEQ ID NO: 79668 - DNA, 371 bp, Homo sapiens
tttacagcttaataattattttgggggaaattattcatattacttttaacacacaattacaccatggaatgtacttcattcaatgtgagatgggaaatgtaaagtataaagatcactggttttgtagggaacctatcaataaggaagtcagggcttagttgatgatcgccatggtcatagtactgaattcagagagaaatgcagatcccatgaattcagaactcagtgcacttcagagtgaaatgactgtcttgtaaagcgattttcatattaagactaactcttgttaatactgatgcaaaatcatatccaacaccttgtatttatgtgatgcttcacttttctaaaaggaatttcaattatttgatatt

SEQ ID NO: 79669 - DNA, 709 bp, Homo sapiens
agagttcctggttcccttatcgtgtgacagttctaagtcaattttgtcatgtggttttctgactcacagactagtaagaagttagtaattagagagctaagtagattagggttgttggagatgagaaacccacgttttgggaaaacctggcaagtgacaacttaacatcaaggaagtagtcagaaaagctaaaactgacaaacagaaggtagaagaaagtagctccacactcatgggatgtgaaatctacaagcgtgcatgcccggcaaatgcctctccaatgcactggagcgttttaagtggaaaccactagaatctctgtgtagtctccggaagtggctgtgagggctgcattatctctgcacagcttcctcttggtgggcccagctgtgatctttatggatggcacacatcagctttcaggaaaagcacatgaaaggtgctagggctcttggagctgactgtaggtttgggagttgtctgtctccttgctctagattacagctctgtgtgttgtgtggggtctccatggtttgccaaattatctcttcctcacttagccacaaggctgacagttaggaactatctcttcttgattgcattaggttggctgcttcctgaatgcatatcaaaaggctccttcctttagttcagtgctttcaacctgagctgtgcatcagaatcacctgaggtcctttaaaaaaaaaaa

SEQ ID NO: 79670 - DNA, 456 bp, Homo sapiens
gcgccctctcacgctttttcgcgcttgtgctctcacaccccttttcttgcttctgcgacttcaattcctatgatttctcctagaattcggattactactccctcccttcacgcatttgccacctctatggccaccactatcctcgcgcgacccccgaagtctccgctcccttttccctctcctgcccccgcaacacccccagcccggcagtttgtttaaaggtctgggttaccttgggccccaggcgcgtgatatagaacgtcagcaactgctgctgtccaggcgctcctcagccagccttctctcctgacctctcctcagggctggtcacaagggggccgccccctggcccctcccctctcgacgtgcggcccccaaccccggattctgccctcctgcagtgatgaatggcaccgctgtcccgcgcaggcaggcaaacctcttcctgaaacagac

SEQ ID NO: 79671 - DNA, 272 bp, Homo sapiens
ggggaaactgaggcccagggaggaaaagcactcagccactttattcctatgctccaccctctgagctaatgagctccagaagtgcagactttcaagacagtggcaaaaagccgtctcttcttaggcaggaattgcctctgcctggccatggcactgaccaccccaacccttctaggaattttccagagcaactctgggagctgggaggtgggcagtgagatgggacagactcagcacccaccccattttgcctgcttgttccctgcctcaga

SEQ ID NO: 79672 - DNA, 330 bp, Homo sapiens
ccacatttggttcatgtggaaaggctggctggggctaagacttgcccgtacattagcgacatcatagccagagtgaggacccttagaacagtgcctgtcaagcttttttagtcctagccttttggctgagtcattctttagctcaataatttctactttctaatggaataataacacttgtcaaggtataagcattttttgggaagagctatatggatggttcctaattgaatcacaaaaaatatgcttgtcataaagtctagactaattagaaaactgcaggcctcaaatcctagtgatggaattgtatcaatatattctctacagtta

SEQ ID NO: 79673 - DNA, 511 bp, Homo sapiens
  misc_feature (28)..(28): n is a, c, g, or t
  misc_feature (73)..(73): n is a, c, g, or t
  misc_feature (94)..(94): n is a, c, g, or t
  misc_feature (121)..(121): n is a, c, g, or t
  misc_feature (216)..(216): n is a, c, g, or t
  misc_feature (241)..(241): n is a, c, g, or t
  misc_feature (272)..(272): n is a, c, g, or t
tctcttctcaataaaatacaagatattncatagccaagatgtgcaaatggtctatttggtcactaagtttttnaaagggaaggggcaggggatnagaattcatcggaaccgaacttaggtngagtaccctaattttccttgcacccatgcctgtccaatcagatgactctgggaaacgccaaacaggctgaatcaatgtcttggtgtggttttttncttccagatggtttttttttctcanctataaaaggatctatctttaaaaataaacngtattaaatctgtaacatcaaaggcagaaggttggtgtgtgtgtgtgtgtgtgtgtgtatgggtatgtgtgaaattccacaggaaatctgatacgtagccagaatcaagcaccctcacattactgatttcagggagtatggcactgtgaaccgtgtaagcctgaggtggggaggtgatttaaattctattataagctgatacctactatctaagaccctgtcaaatgatcatatcaaaa

SEQ ID NO: 79674 - DNA, 1256 bp, Homo sapiens
tgtctgtgtgtctttgtgtgtaaaagcaacgcataaacatacccagggctttcacttattttattgaagcaaacaaacaaaaacagccactgggtttgtcttttcccctactcctgcctgagcgccgccgggtttctgagctgctccgggcgcggacctagctcacccgcagccggatgtcggagccggagctgctccccacccggcctcgcccgcgggcgacaaaaccgtccctctggccacgggagagcatcgccttgccaaaatcaactcgcattttcatgtattcaaatgagaaagactgagaagggcgatttcccctgctgggcagtcgacagcgttggaaggaagaagtgccccctagggcctcgcggaaacgggaacaaacctccctcgaggcccccggaaccgatatggcgaccccgcccagacctgggtccccgcggccgcgcgcgtctcccgccgttgtggcccccgagttactgacttttgttcacaccggtcagcgcctgttggaggacgtgctcagccccagccggtccctcctcatccagccgatccccctcctggggagcgcggtctctgctctgtgctgctgaaaggatcctcgggctttcccgctctactttaaaacccctagggctaggggcctaggggagggactggcaatgcacgcttcacacaaagaggtggaaaattagagggaaacgtgacacctcttaggtatccgttagagcagaaaggacctgagcagctgaggtcctactgcgtgccacagacttggcagggtgcttggagatcctggcgtttccccacctgctgctcctgtgtgcaagagctgggaggctggaaacctgggcgagggtaggtcaggacctccattcctctccatcagcagaagcccgcgttaatgcagagcagtgatggaagccgaggggcttggaaaagtcaactatttcatctcctgcctcaaggctggcagcttaaatctaaatccttcctgaagggtcgaccagtgtttagcttctccgtcccaggccggccagcccccgccaatccactcgcgcccctccccccacacacccaggagctttcccacggtctttcagttgtccctggtggtttagctttggctattcatatgtgattaccctcaaattacatggcactatttaacagatgctttaataagaatcatatgccatatccttcacttagaaagaaaataaaaatatattctgccggaagtttttcat

SEQ ID NO: 79675 - DNA, 784 bp, Homo sapiens
aacagagcaagaccctgtctcaaaaagaaagaaagaaatgaggatatgagtttgctgctctttaaatcgatgactttgcagctcttcatctgaagaggtggcgtctgtttctcctgtttgagtgtggcacatccaggagagtggctttgagcagtggtgtggcagacgtgactgtaggccagccctgagctgaggctgccaggggactgcacacttcttctctcagctctgccagctgctgcactgtgtctgggccagcccgctggagcacagagttcagtgcattgggacagctacagcccattgcatcgggacagcccacagcaacaagacccacctgtcgccactgcaggtgcgtgagggtgcccggctgagagcagacaaaccgcctagcaggtggcttttcaagcggaatcacagactagctccatcgctgtggtgaacgttctccccagtgccaggattccacttggcccctgactgcttgagcagccgatgtgacagccatctctctgctgccgtgcatgtcggctgggctggagccagtgcatcaggaagtagacgcagaagtggatcaggagcaaaacattcctgagagctggcagaagctggcgtctggagccgctgggatgcgggtatgggctctctcagtggcggaggaacagcctcctggcagaaccaaaggttgctttgtgccttcgatgctgctgctggccagagtggttttctgtctcagaccctgtaccacgtgtctgttctttctcattttttacttaaaggagaa

SEQ ID NO: 79676 - DNA, 263 bp, Homo sapiens
tccaaacggggaaaccgtcattgaccttgacattgtgccgccttcttcagcctttcaagcccttttggatagaagcccttcccctacagcacacacagtattttcagtgtgcactcagcctaaggctgccttctcccctgagaccccactgcaaaggtgcagcccagcaccccgtgcacacacccccagccgctccctctgcccagatgggctgcccccatttcctccattcagtctgcctggacgggctgccccacctcctg

SEQ ID NO: 79677 - DNA, 545 bp, Homo sapiens
ctgtgaggcctccagtgagaaatgggaggcagttctgggagggggttttttcagtgtcaccaacagagtcaacaaggaaacataattagagggctttgaaatgatctactgaaatacctaaattgatagaaattaatcatactcaatctaggacatgttcctttactccttaaaaaagaaaggaaagatctctaaattcaaagctagattgtaaataggcattcaagaagtattgtcttaaatttacgatgaatttcttgtgagcagaggacgaaacaggtgaattctcaccagactcaaaccagatctcaattcgtagtaatgctaaatcgtcttccgtgttctcagaggttcttttcagtgtctgtcagaacttggcatactttctccatagtacgtagaccttctaatactctgctaaatgaaaccacacttgttatctgaaagtgtgtgaaagaaacaatgtatgaaaatttacatttgatcatccggcattggaaatagtttgaactatttccaaaaatcccttaggggatgaggggtga

SEQ ID NO: 79678 - DNA, 865 bp, Homo sapiens
tcaaatgagagcttacactgttgtttgatttatcaatttttagacttgtttttaatctattgatgaatgtagacattaggtatatccgtctattttgttaagtgaggacctagctttctcatactttctgtatcctttctaaggtattcataaactacttatgaatcaattactagttatcagtagaaaagatttacatttgactgtgcaggtattcacttttataccaagtgatttgcgactgcttgctttcttatagaaacgttatttttcctggagttgataatttgccttgctttttcatttgcctactttttttttttaagtatcataatattttcaacatctctgctacatgtgtatggctattatttttcatatgctcaaaagcatagattattattttattttctagagagctccttcttagacattctgttgttttctccagttttgacatgtttctccccaggcctgctgcacacacgtctgtctggaatttctcttgagcatcttcctgagacttatcttcatccctgtttacttcttctatctttttttttttttttttttttttgaggcagtctcgcttttttcccccgggttggaaccccagggggcttgatcctgggctctcactgtgaaacctctcaaccttctccaatttcggggtgattctctcgggcctatatagccctccgtgaagtaaggcggggatattcacgaggaacccacaccaaccaacacacccaagattaattttttaatatatttgaggggtgtttttcccctaatatgtggcaccaggtctggtctcaagagctcctgtccctcagttgatttgcccacttttgacttcccaaaa

SEQ ID NO: 79679 - DNA, 2331 bp, Homo sapiens
  misc_feature (1001)..(1001): n is a, c, g, or t
  misc_feature (1015)..(1015): n is a, c, g, or t
tcaaatgagagcttacactgttgtttgatttatcaatttttagacttgtttttaatctattgatgaatgtagacattaggtatatccgtctattttgttaagtgaggacctagctttctcatactttctgtatcctttctaaggtattcataaactacttatgaatcaattactagttatcagtagaaaagatttacatttgactgtgcaggtattcacttttataccaagtgatttgcgactgcttgctttcttatagaaacgttatttttcctggagttgataatttgccttgctttttcatttgcctactttttttttttaagtatcataatattttcaacatctctgctacatgtgtatggctattatttttcatatgctcaaaagcatagattattattttattttctagagagctccttcttagacattctgttgttttctccagttttgacatgtttctccccaggcctgctgcacacacgtctgtctggaatttctcttgagcatcttcctgagacttatcttcatccctgtttacttcttctatctttttttttttttttttttttttgaggcagtctcgctttttcacccaggctggagcacagtggcatgatactggctcactgcaacctccaccttccaattcaagtgattctcatgccttagcctcctgagtagctgggattacaggcacccaccaccacacccagctaatttttatatttttggggtttctccatattggaccaagctggtctcaaactcctgtcctcaagtgatctgcccaccttagcctcccaaaatgctgggattacagatgtgagccactgcacccagcctgtttcttgcatcttatatttacttctatttactttcttttctggtgaattatttccatcaacatttgctgcaaaaggagtacacataggccggacgcagtggctcacgcctgtaatctcaacatggtaggctgaggcgggcagattgtctgngctcaggagcttgngcccagcctgagcaacgtggagaaaccctgtctctgctaaaaataaaaaaaaattgggtgcattggcatgcgcctgtggccccagctacctgggaggctagggtgggaggatcgcttgagcccaggaggtcgaggatgcagtgagacaagatcatgccactgcgctccagcctgggtgacagagtgagaccttgtcttaaaaaaaaaaaaaagaaaaaaagtacacagaatatacattttttgtgatctttatttccagtgatgagcactgcacctaacaacagcagaatattcttctcaactacactaggaacattctgcacgctaggccatgaaacctcaatagattaaaatgatagaatgaatacacagtatgttctctgaccacaatagaatgaaattagagtcaataatagaaaggtatttagaaaacccacaaacagctcactcttaaatagtcagtgggccgaagaggaaatcaaaagagaaataagaaaatacactaagaaatacattgagatgaatgaaaatgaagacatggcataccaaaatgtatgggataaagctcaagcaatgcttctagggaaatttatagctgttaatgcctacaataaaaagaaagctctcaaatcagtaatcgattcaccaccataagacactggaaaaagaaaagcatactaaacctgaagacagcaaaaggaaggatgtaatcaagattaaagcaaaagttaatgaaatagagactgggaaaaccagtgaaaccaaaagctggttctttggaaagatcaacaaaattgacaaacctttagctaaacatatcagggtaaaaagagaaaacattcaaattactggaattacaaatgtgctgggtgtggtggcacacacctgtaatcccaacacctgggtgtggtggctcacacctgtaatcccaaggtgggaggatcacttgaggctgggagtctgagaccagactgggcaatatgacaagacctcatctatgcaaaaaaagaaaattcaaaattaggtgggtatggtggtgcatgcctgtagtcccagatactcaagagactgaagcaggaagatcactagagccaaggagttcaagggtgcagtgagctatgatcatgctgctctactccagcctggatgatagtgagactcccaactcatatataaaaaaaaaaaaaaaaaggaaatgaaaccgtagtcgttacctattgtggcaggaaatcactagaaaatgtctcaagctgataatgaagagataattgtataagcctgtcaatcctatcagtaaaaacaagcattacaaaagg

SEQ ID NO: 79680 - DNA, 555 bp, Homo sapiens
ttctcactctaccttcaagacctcgcttcctctgcccattggacctgccagtctctcatgcccacagatctatttgtaaaatctcatgtctgattacatagaacccccgctctagattcttccatggccctgatcactctgtgttataactctgtgtattggctattgtggccagttttctacaagtaaccggatttttcctctgaattttatgggatttctcctcattggcacaatatgcagggctcagggttgtagcacccctcattatgtcgaatgacccatctctacatgtttgtttctcatctccaggattctggtccatgttgaagagttttcaaccaagggaggaacctctctggcaggggacacaagaactgtgtcatcaaattgaaccctgagacagccacaaggccaactggggctctttaagcccctggaggttaggctgatgtgaatagagttcatgctattggctgcactaattgatcccctaatccgggggaaagaaggttgctgttgaacaacaggaaactcagcaaacatgcagacaat

SEQ ID NO: 79681 - DNA, 344 bp, Homo sapiens
tttttttttagatggggtctcgctgtgtagcccaggctggagtgcaatggcgtgatctcagctcactgcaacctctgcctcccgggttcaagcaattctcctgcctcagcctcccaagtagctgggactacaggagcgtgccaccaggcccagctaattttttgtatttttagtagagacgggatttcactgtgttagccaggatagtctcgatctcttgacctctccgcccacctcagtctcccaaaatgctgggattacaggcatgagccaccgcgcccgggccttcagaagtatattttaataaaaatgcttcagaagtatgaaaatggttgtgtagttat

SEQ ID NO: 79682 - DNA, 441 bp, Homo sapiens
ccatggtgttgctttcaggcaacgtacatgtgcctgccatgtataagacaccacctggttaggactgagctttagcctcggagaaggaagaccagagcatccgaaggcaagatacagaagaggaagcatatggcaacgctctctgtaaaaagatggggccgggtgtgggggctcacgcctgtaatcccagcactttgggaagccgaggcaggtggatcacttgaggtcaagagttcgagaccagcctgggcaacatggtaaaaccccatctctactaaaaatacaaaaattagccaggcgtggtggcacgcacctgtagtcccagctgcttgggaggctgaggcaggagaatggcttgaacccaggaggcagaggctgcagtgagctgagattgtgccactgcactctagcctggggaacagagcaagactctgtctcaaa

SEQ ID NO: 79683 - DNA, 7385 bp, Homo sapiens
ggcgccgccggaccgcgccccaccccgcgcgcccgagcagggcgactgtcattagcttcctggacgggacccggggcgggatcctggtgtcctgaaaggggcccgggcgaccctaagaggaagaacttttgggggcggggtccccggtcccgcgtcccctgggcagccgctattgtctacgcgcctcgctgggcggcgcggggggcgtgatcgcggcggccccgggctctgggtgcggagacccaggcggggctgggcccagggcggcggcgggagaagccggggaagccgaagagcctggggaggaggagctgcgagcgcgggagacgagcaggagccgcgcgggccgcggcgagcgcgatgccggcggcggcgggggacgggctcctgggggagccggcggcgcctgggggcggcggcggcgcggaggacgcggccaggcccgcggcggcctgcgagggaagtttcctgcctgcctgggtgagcggcgtgccccgcgagcggctccgcgacttccagcaccacaagcgcgtgggcaactacctcatcggcagcaggaagctgggcgagggctcctttgccaaggtgcgcgaggggctgcacgtgctgaccggggagaaggtggccataaaagtcattgataagaagagagccaaaaaggacacctatgtcaccaaaaacctgcggcgagagggtcagatccagcagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccataggtgtgaacatgtatgccatgttgaccgggacgctgcctttcacggtggagcctttcagcctgagggctttgtaccagaagatggtagacaaagaaatgaaccccctccccactcagctctccacaggtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaagattcctttggctgccgcaatattttccgcaaaacctcagattccaattgtgtggcttcttcttccatggagttcatccccgtgccaccgcccaggaccccgaggattgtgaagaaaccggagccccatcagccagggcccggaagcactggcatcccccacaaggaagaccccctgatgctggacatggtgcgctccttcgagtctgtggatcgcgacgaccacgtagaagtgctgtctccctctcatcactacaggattctgaactccccggtcagcttggctcgcagaaattccagcgagaggacgctgtccccgggtctgccatccggaagcatgtcgcctctccatactcctttgcatccaactctggtctcttttgctcacgaagataagaacagccccccaaaagaggagggcctgtgttgcccacctccggttcccagcaatggccccatgcagcctctggggagccccaattgtgtgaaaagccgaggccggttccctatgatgggcatcggacagatgttaaggaagcgccatcagagtctgcagccatctgcagataggcccctggaggccagcctgcccccactgcagcccctagcccctgtgaaccttgcctttgacatggccgatggggtcaagacccagtgctaacttgggccagcggggtttggggtatctctagaaaacagcaactgaacagagctccacacatctgtcagggtgtgagcactccaaggcctcgcgtggagcatccttagtcccacctgtagctgaatccacagacccaaagcctgcacaacccaacctcgcttagggacccccagagatgctggaatcgctaggagggttggctccaggggcagccaattcctatcattcagatcttccttcctcccaagtactcaccaaccccttccacttcccacttcccccaggcttggggggaaaacagggcatgagccttctggggcactcagattatggactgttaccagatctttcttcacgctgtgctacatgtgtgcctctcacagcagttggccacagttacagggagagaacaatatcacagtcattcatccaggccacgtttcctctgcggagtgtagcagccctgcctttcatagcagggattacctgaaggccagcaggagccgggggcaggcccaggatcctcagaggaagatggagaggagcttcggaccaagatcaaaccaaacagtggggaccccaacagaagagaaagactgaaggagacactcatttcccaagcaagattttgatagatttttgttgttgttgttgttgaaacatgctaatgattgaattatcttttccaaagattttttttaaatgtgatgtcggtaaattgaaataacataattttttaaaacttggatggagagatgagaagcaattccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaaaaaaatagctgggtgtggtggtacgtgcctgtagtcccagctacttcggggactgaggtgggaggatcacttgaacctaggaggtcgaggctgcagtgagccaagatcatgctactgcactccagcttaggtggcaaagtgagaccctgtctccaaaaaaagaaaatagagctttataagcagagagaagaaaataatcatctaagaccatctctccattcgacatgaagtgtaccttttctaaagacggtttccagctgcaacggctccactttgcaggcttgcagggtgtatacctgcgcattgggaacttgctggaacccctgatgcattttccttgagagcaggggtacttccgccttgccgttagcttgtggagaacgtgcttcttattcctggcaggcttcaagaacagctgcacatgtgccgctaactgaccgcgttgccattggcgacctggactctgaactcaggtttattctaaacccagtgagcggtgagggggagtgatgaaaggggatcagctgtatttgtgtgtgtgtgtgtgtgtgagcacctgacaaatctatgaaaccgagtgaaaggagaaatgttagattctttattattttattatatttatatggaaagctcgactctccctttggtaagtccgaagcatgttgtttgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcactacgactgcttctttatttgctgataaatcttaaaacaactaagtacgttgcaaataatagtacaggtaccatcttttatgtgaagttctttttctttttttgagacagggtcttgctctgtcacccaggctggagtgcagtggcacaatcacagttcactgcagcctcaacctctccagattcaagtgatcctcccatctcagcctcccaagtagctgggactacagttgtgcaccacaatgcctagctaattttttttgtattttgtagaaatggggtttcgccatgttgctcaggctgatctcaaactcctgggctccaacgatctgcccaccttggcctcccaaagtgctgagattacaggcgtgagccactgtgcctggccttatgtaaagctcttgacctagcatctgactggaaacaagcgggaattgcattggggggcattttctgggccagtttccctgccttattttacctgcaataggtgtgcctacaaaagtctttctgacatacacactgcaggtggcagttcaagaagaatcaacctttttcatttggggatattaggatcttccttggagactctgaaaatggcacacaaagaatggcagttatgaacgtgacttctagattttgtccttgtaggaggccttggtcatggataggggaagagggatgatgggatggaatgggagggtgggatctagatgacctcttgaaattgtcccagttactgcttccttcataactgttcacaaaacgtttttcatatataccaccttgtttcccctgggaagtgaggggacgaagccttagagggtgacatagctagaaagtggagaagctcactgttcactgtgcaaagccccagtagtcggattccggggaaaagaacaagtatctagttttgatgacaatgttttcttgtaagaatcccaacactttagaatagaaaaggacctaagattctctggctcagccccagcctttctgaagaagggaaaactagggacccagatggtttaaggacaccccagagtccccagatgagctggcatttgagctggtctggagcagagtttctccctcaaagaacacagagaaatcagagagtggctgccatggtcagagggggatgtcaacaacagatcaagccgtcatcacaacaggtatttctgaagttcctgcagggactaggtcttgcatttttaagtccttttcaaaactgtgcagcttcctgaaccttatgctgtttgtcccatccactcttgaagctggggaaagacagctttctttgggaactctgtctttctcagttgacttcccaagtaagcagcaaacccctggatagccttgttatctactttaggtattaagaggctattgggttttactagattaaatcaataaaacatttcctatagagccatatcatacactgaagcaaattcagaaagaatgcaaaactgctatcttttgggggagtctggaagcctgttggttagtgtatttattttctttgtggggtcttctgtgagctacaggcacagtaagaataattcagagcggtactgggagttggttcaatttcatgtcatcacttttcaatgaagggagtgcatttcctgagtagtaaatgagtatattatttgtggcagcttttctgttaagggagctttccagacatctggttgcaaagacaaataggatatatatttgtacttcttctctgtggacatgtttttgtgacacacagttatctctaggagttgacgtctgtgggcactaagggactgaggttgggggagaaagctgaggaggctttggaagagaaggtgaggagcatttcaggatttgcagtccccctccacatgtatccacatctgagctggtggtgttccaataatgaggcatttggggcaaccaattttggaaggatagaatagctttatgtggagcaaacttgaggatcaattggagttgagtggtttaaaacttaaagatggcacaggaagctgtatcatttacaggtgaaaaaaataaatgggtctgacttca

SEQ ID NO: 79684 - DNA, 5197 bp, Homo sapiens
ggcgccgccggaccgcgccccaccccgcgcgcccgagcagggcgactgtcattagcttcctggacgggacccggggcgggatcctggtgtcctgaaaggggcccgggcgaccctaagaggaagaacttttgggggcggggtccccggtcccgcgtcccctgggcagccgctattgtctacgcgcctcgctgggcggcgcggggggcgtgatcgcggcggccccgggctctgggtgcggagacccaggcggggctgggcccagggcggcggcgggagaagccggggaagccgaagagcctggggaggaggagctgcgagcgcgggagacgagcaggagccgcgcgggccgcggcgagcgcgatgccggcggcggcgggggacgggctcctgggggagccggcggcgcctgggggcggcggcggcgcggaggacgcggccaggcccgcggcggcctgcgagggaagtttcctgcctgcctgggtgagcggcgtgccccgcgagcggctccgcgacttccagcaccacaagcgcgtgggcaactacctcatcggcagcaggaagctgggcgagggctcctttgccaaggtgcgcgaggggctgcacgtgctgaccggggagaaggtggccataaaagtcattgataagaagagagccaaaaaggacacctatgtcaccaaaaacctgcggcgagagggtcagatccagcagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccatgtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaagattcctttggctgccgcaatattttccgcaaaacctcagattccaattgtgtggcttcttcttccatggagttcatccccgtgccaccgcccaggaccccgaggattgtgaagaaaccggagccccatcagccagggcccggaagcactggcatcccccacaaggaagaccccctgatgctggacatggtgcgctccttcgagtctgtggatcgcgacgaccacgtagaagtgctgtctccctctcatcactacaggattctgaactccccggtcagcttggctcgcagaaattccagcgagaggacgctgtccccgggtctgccatccggaagcatgtcgcctctccatactcctttgcatccaactctggtctcttttgctcacgaagataagaacagccccccaaaagaggagggcctgtgttgcccacctccggttcccagcaatggccccatgcagcctctggggagccccaattgtgtgaaaagccgaggccggttccctatgatgggcatcggacagatgttaaggaagcgccatcagagtctgcagccatctgcagataggcccctggaggccagcctgcccccactgcagcccctagcccctgtgaaccttgcctttgacatggccgatggggtcaagacccagtgctaacttgggccagcggggtttggggtatctctagaaaacagcaactgaacagagctccacacatctgtcagggtgtgagcactccaaggcctcgcgtggagcatccttagtcccacctgtagctgaatccacagacccaaagcctgcacaacccaacctcgcttagggacccccagagatgctggaatcgctaggagggttggctccaggggcagccaattcctatcattcagatcttccttcctcccaagtactcaccaaccccttccacttcccacttcccccaggcttggggggaaaacagggcatgagccttctggggcactcagattatggactgttaccagatctttcttcacgctgtgctacatgtgtgcctctcacagcagttggccacagttacagggagagaacaatatcacagtcattcatccaggccacgtttcctctgcggagtgtagcagccctgcctttcatagcagggattacctgaaggccagcaggagccgggggcaggcccaggatcctcagaggaagatggagaggagcttcggaccaagatcaaaccaaacagtggggaccccaacagaagagaaagactgaaggagacactcatttcccaagcaagattttgatagatttttgttgttgttgttgttgaaacatgctaatgattgaattatcttttccaaagattttttttaaatgtgatgtcggtaaattgaaataacataattttttaaaacttggatggagagatgagaagcaattccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaaaaaaatagctgggtgtggtggtacgtgcctgtagtcccagctacttcggggactgaggtgggaggatcacttgaacctaggaggtcgaggctgcagtgagccaagatcatgctactgcactccagcttaggtggcaaagtgagaccctgtctccaaaaaaagaaaatagagctttataagcagagagaagaaaataatcatctaagaccatctctccattcgacatgaagtgtaccttttctaaagacggtttccagctgcaacggctccactttgcaggcttgcagggtgtatacctgcgcattgggaacttgctggaacccctgatgcattttccttgagagcaggggtacttccgccttgccgttagcttgtggagaacgtgcttcttattcctggcaggcttcaagaacagctgcacatgtgccgctaactgaccgcgttgccattggcgacctggactctgaactcaggtttattctaaacccagtgagcggtgagggggagtgatgaaaggggatcagctgtatttgtgtgtgtgtgtgtgtgtgagcacctgacaaatctatgaaaccgagtgaaaggagaaatgttagattctttattattttattatatttatatggaaagctcgactctccctttggtaagtccgaagcatgttgtttgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcacta

SEQ ID NO: 79685 - DNA, 4611 bp, Homo sapiens
ggcgccgccggaccgcgccccaccccgcgcgcccgagcagggcgactgtcattagcttcctggacgggacccggggcgggatcctggtgtcctgaaaggggcccgggcgaccctaagaggaagaacttttgggggcggggtccccggtcccgcgtcccctgggcagccgctattgtctacgcgcctcgctgggcggcgcggggggcgtgatcgcggcggccccgggctctgggtgcggagacccaggcggggctgggcccagggcggcggcgggagaagccggggaagccgaagagcctggggaggaggagctgcgagcgcgggagacgagcaggagccgcgcgggccgcggcgagcgcgatgccggcggcggcgggggacgggctcctgggggagccggcggcgcctgggggcggcggcggcgcggaggacgcggccaggcccgcggcggcctgcgagggaagtttcctgcctgcctgggtgagcggcgtgccccgcgagcggctccgcgacttccagcaccacaagcgcgtgggcaactacctcatcggcagcaggaagctgggcgagggctcctttgccaaggtgcgcgaggggctgcacgtgctgaccggggagaaggtggccataaaagtcattgataagaagagagccaaaaaggacacctatgtcaccaaaaacctgcggcgagagggtcagatccagcagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccataggtgtgaacatgtatgccatgttgaccgggacgctgcctttcacggtggagcctttcagcctgagggctttgtaccagaagatggtagacaaagaaatgaaccccctccccactcagctctccacaggtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaagattcctttggctgccgcaatattttccgcaaaacctcagattccaattgtgtggcttcttcttccatggagttcatccccgtgccaccgcccaggaccccgaggattgtgaagaaaccggagccccatcagccagggcccggaagcactggcatcccccacaaggaagaccccctgatgctggacatggtgcgctccttcgagtctgtggatcgcgacgaccacgtagaagtgctgtctccctctcatcactacaggattctgaactccccggtcagcttggctcgcagaaattccagcgagaggacgctgtccccgggtctgccatccggaagcatgtcgcctctccatactcctttgcatccaactctggtctcttttgctcacgaagataagaacagccccccaaaagaggagggcctgtgttgcccacctccggttcccagcaatggccccatgcagcctctggggagccccaattgtgtgaaaagccgaggccggttccctatgatgggcatcggacagatgttaaggaagcgccatcagagtctgcagccatctgcagataggcccctggaggccagcctgcccccactgcagcccctagcccctgtgaaccttgcctttgacatggccgatggggtcaagacccagtgctaacttgggccagcggggtttggggtatctctagaaaacagcaactgaacagagctccacacatctgtcagggtgtgagcactccaaggcctcgcgtggagcatccttagtcccacctgtagctgaatccacagacccaaagcctgcacaacccaacctcgcttagggacccccagagatgctggaatcgctaggagggttggctccaggggcagccaattcctatcattcagatcttccttcctcccaagtactcaccaaccccttccacttcccacttcccccaggcttggggggaaaacagggcatgagccttctggggcactcagattatggactgttaccagatctttcttcacgctgtgctacatgtgtgcctctcacagcagttggccacagttacagggagagaacaatatcacagtcattcatccaggccacgtttcctctgcggagtgtagcagccctgcctttcatagcagggattacctgaaggccagcaggagccgggggcaggcccaggatcctcagaggaagatggagaggagcttcggaccaagatcaaaccaaacagtggggaccccaacagaagagaaagactgaaggagacactcatttcccaagcaagattttgatagatttttgttgttgttgttgttgaaacatgctaatgattgaattatcttttccaaagattttttttaaatgtgatgtcggtaaattgaaataacataattttttaaaacttggatggagagatgagaagcaattccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaaaaaaatagctgggtgtggtggtacgtgcctgtagtcccagctactttgccacctaagctggagtgcagtagcatgatcttggctcactgcagcctcgacctcctagattcaagtgatcctcccacctcagtccccgaaggtcgacgcggccgcgaattagtagtagta

SEQ ID NO: 79686 - DNA, 5325 bp, Homo sapiens
ggcgccgccggaccgcgccccaccccgcgcgcccgagcagggcgactgtcattagcttcctggacgggacccggggcgggatcctggtgtcctgaaaggggcccgggcgaccctaagaggaagaacttttgggggcggggtccccggtcccgcgtcccctgggcagccgctattgtctacgcgcctcgctgggcggcgcggggggcgtgatcgcggcggccccgggctctgggtgcggagacccaggcggggctgggcccagggcggcggcgggagaagccggggaagccgaagagcctggggaggaggagctgcgagcgcgggagacgagcaggagccgcgcgggccgcggcgagcgcgatgccggcggcggcgggggacgggctcctgggggagccggcggcgcctgggggcggcggcggcgcggaggacgcggccaggcccgcggcggcctgcgagggaagtttcctgcctgcctgggtgagcggcgtgccccgcgagcggctccgcgacttccagcaccacaagcgcgtgggcaactacctcatcggcagcaggaagctgggcgagggctcctttgccaaggtgcgcgaggggctgcacgtgctgaccggggagaaggtggccataaaagtcattgataagaagagagccaaaaaggacacctatgtcaccaaaaacctgcggcgagagggtcagatccagcagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccataggtgtgaacatgtatgccatgttgaccgggacgctgcctttcacggtggagcctttcagcctgagggctttgtaccagaagatggtagacaaagaaatgaaccccctccccactcagctctccacaggtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaagattcctttggctgccgcaatattttccgcaaaacctcagattccaattgtgtggcttcttcttccatggagttcatccccgtgccaccgcccaggaccccgaggattgtgaagaaaccggagccccatcagccagggcccggaagcactggcatcccccacaaggaagaccccctgatgctggacatggtgcgctccttcgagtctgtggatcgcgacgaccacgtagaagtgctgtctccctctcatcactacaggattctgaactccccggtcagcttggctcgcagaaattccagcgagaggacgctgtccccgggtctgccatccggaagcatgtcgcctctccatactcctttgcatccaactctggtctcttttgctcacgaagataagaacagccccccaaaagaggagggcctgtgttgcccacctccggttcccagcaatggccccatgcagcctctggggagccccaattgtgtgaaaagccgaggccggttccctatgatgggcatcggacagatgttaaggaagcgccatcagagtctgcagccatctgcagataggcccctggaggccagcctgcccccactgcagcccctagcccctgtgaaccttgcctttgacatggccgatggggtcaagacccagtgctaacttgggccagcggggtttggggtatctctagaaaacagcaactgaacagagctccacacatctgtcagggtgtgagcactccaaggcctcgcgtggagcatccttagtcccacctgtagctgaatccacagacccaaagcctgcacaacccaacctcgcttagggacccccagagatgctggaatcgctaggagggttggctccaggggcagccaattcctatcattcagatcttccttcctcccaagtactcaccaaccccttccacttcccacttcccccaggcttggggggaaaacagggcatgagccttctggggcactcagattatggactgttaccagatctttcttcacgctgtgctacatgtgtgcctctcacagcagttggccacagttacagggagagaacaatatcacagtcattcatccaggccacgtttcctctgcggagtgtagcagccctgcctttcatagcagggattacctgaaggccagcaggagccgggggcaggcccaggatcctcagaggaagatggagaggagcttcggaccaagatcaaaccaaacagtggggaccccaacagaagagaaagactgaaggagacactcatttcccaagcaagattttgatagatttttgttgttgttgttgttgaaacatgctaatgattgaattatcttttccaaagattttttttaaatgtgatgtcggtaaattgaaataacataattttttaaaacttggatggagagatgagaagcaattccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaaaaaaatagctgggtgtggtggtacgtgcctgtagtcccagctacttcggggactgaggtgggaggatcacttgaacctaggaggtcgaggctgcagtgagccaagatcatgctactgcactccagcttaggtggcaaagtgagaccctgtctccaaaaaaagaaaatagagctttataagcagagagaagaaaataatcatctaagaccatctctccattcgacatgaagtgtaccttttctaaagacggtttccagctgcaacggctccactttgcaggcttgcagggtgtatacctgcgcattgggaacttgctggaacccctgatgcattttccttgagagcaggggtacttccgccttgccgttagcttgtggagaacgtgcttcttattcctggcaggcttcaagaacagctgcacatgtgccgctaactgaccgcgttgccattggcgacctggactctgaactcaggtttattctaaacccagtgagcggtgagggggagtgatgaaaggggatcagctgtatttgtgtgtgtgtgtgtgtgtgagcacctgacaaatctatgaaaccgagtgaaaggagaaatgttagattctttattattttattatatttatatggaaagctcgactctccctttggtaagtccgaagcatgttgtttgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcacta

SEQ ID NO: 79687 - DNA, 4868 bp, Homo sapiens
ggcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagattcgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcaaaaaaaaaagaaaaaaaagagaaacaagacaagactaaaacaattagagcaacagcagcgaaacagaacgtgaaggaagagctacagaacaagagacgagagccgaacccaaaaggacgacgggggcgggcggcagatacataacatatacgaaggaggagcgacatcagagacacccagccgccgtgttgtatgacagacggacgcgcctcaaacaggagaattataaaaaaaagcggcgcagcggggcgtcaaaaaaacggcggggggaacaaacagcgtgcgtgatactgtgcagcaaacacctcgggtggggggaagaacagaccaaacacacaaggagacgcacgagagat

SEQ ID NO: 79688 - DNA, 496 bp, Homo sapiens
  misc_feature (486)..(486): n is a, c, g, or t
ggcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatganaaatgcttta

SEQ ID NO: 79689 - DNA, 3851 bp, Homo sapiens
gacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagattcgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaaaaggtagaataaaagtttcagagtaagcaagacctcagaaaaaatattgtctttatatcctttctgaggaagctttctggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctca

SEQ ID NO: 79690 - DNA, 3010 bp, Homo sapiens
ccgctacaagaaggtggccaggaaggtggccacgttgagaaacatgtcgatctcgggcgtctcctggtaggtcttggaaagctccttggcgatgacctccttggccatgctgagctccttggagtcggtctccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagattcgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctca

SEQ ID NO: 79691 - DNA, 2863 bp, Homo sapiens
tccccacactcacccccagcactccacccacattcaccgcagtcatgagccccgggtgtttaatccggacgagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagattcgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctca

SEQ ID NO: 79692 - DNA, 2058 bp, Homo sapiens
caagagtggtgccatgaattgcatgcatatttcgtggtggtctacgggttctgtgatacacaagaggcgtgtgccaacaacactttctggttccatattaatcttgatgctgtggcaatctataggctagtcttgatgtactctgaattagcctgaatatctctaactaagttgagctgtcttacttaccaagtttacactgaggatgctgccggtggcccccggcaggatgtactgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctca

SEQ ID NO: 79693 - DNA, 1325 bp, Homo sapiens
ggcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacat

SEQ ID NO: 79694 - DNA, 1256 bp, Homo sapiens
ggcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgaccgtgtcgctatagtgacgggagggacagatggcattggctattctacagcgaagcatctggcgagacttggcatgcatgttatcatagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacat

SEQ ID NO: 79695 - DNA, 647 bp, Homo sapiens
ctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctcca

SEQ ID NO: 79696 - DNA, 4512 bp, Homo sapiens
ggcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagattcgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctca

SEQ ID NO: 79697 - DNA, 603 bp, Homo sapiens
  misc_feature (593)..(593): n is a, c, g, or t
gacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagagacgtgagtcttgctgtgttgcccgggctggctttgcctctggaactcaagcgatcctcccacctcagcctctcgaggagctgggactacaggcgtgcaccatcatttcctcctaaaattgtatgtgctgcatatataaaatganaaatgcttta

SEQ ID NO: 79698 - DNA, 4619 bp, Homo sapiens
gacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagattcgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctca

SEQ ID NO: 79699 - DNA, 648 bp, Homo sapiens
atacctggaccaagtatgtgggacgtgcagcgggttctctgcctccgtgaagacaagctgggctggggaggacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatcctttgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctca

SEQ ID NO: 79700 - DNA, 1432 bp, Homo sapiens
gacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacat

SEQ ID NO: 79701 - DNA, 313 bp, Homo sapiens
actttattggaggaaggaggagcagaaagaggagaaggaaacgttaactcctaaatcacaaggcagaaaggattcctgaaacaaatcagccaaatctgcctcctaggtggttccagacctgccccctcccctccccgtttcttagggcgcggcagtaacatttacccggctccactgcacatcctcctgaccctggccctgcgctcttggcctctgcacatctcatggctggcacctccgtgcgcgctctcatttcatgtttcaccttcaaattgtcctctgtgaacacgtgtatgcatgcacatttattgat

SEQ ID NO: 79702 - DNA, 864 bp, Homo sapiens
aagaagtctcaaaggaaataaaaaaatttttaaactgaatgcaaataaaaatgacaacccaaaatttgtgggacacagctaaaccaatgctaaaatggaaatttacagccttaaatacttatgttagaaaaaaagggcttaaatcaattatttatatcaagggttgccaaactttgcttccctgcttgtttttgtaaataaagttttactggaacacagtcagtattatccatcgctgctttggtattacaacggcagagttgagtagttgtgacagatcatttggtctgcaaagcctgaaatatttactatctggccctttacaaaagatttgccaaactgatccaactattgtcttaagaaactagatacctgcagaagttttcttagaaactgaaataagacaaaggtatatattaataggaaaaaatttacagttaatgaaaaaagaaactagaaagagaacaactaaaaaaaccaaagcaagcaggagaaaataacaaagatcagagtacaaatcaatacaattctaaggagaaaactaatgaaactaagaattttggttgcttaaaaacaatcaacaaaattgataaacctttagccagacttaaaaaaaaaggagggtggctggggtaggggtggcgaatacagagagagaggaaagacaaaaattaacaatattaggaatgaagcggggggacatccctactgacatcccatacagtaaaagaataataaactaacactacaaacaactctatggtcatgaatttgataactttgaagaaatggaccaatgtcttaaaaacacaaacttccaaaactcactgaagaagaaatagtctgaatgatcccgtatctatt

SEQ ID NO: 79703 - DNA, 560 bp, Homo sapiens
cttcttatggcattactgaaactcagaaatgttgctgagattctggaggttctctgggagatctgggagtccttgaggggatgtttctgaggttctggggatgctgctggccttccccattccttctggcctgctgttagcttcttctaagcttggcactttgccctttgaggatttgataatcacaggctcccgcagaaatgcacgtgggcctctgctcctggatgcaaaaattcctcaggtttaatcaacttgaacaaaaacatgagaggaaggaagccctgtcccaaggccttcatgggccagctccaacccgaggggcatagcagctctgtgccaagcccaaatggcagatggccttcactggctcagagtccagaagctttttaggacctcctcccatagtgagcagggcttagccacccgccaatctgtgcccagttgggagacctgctggtttgagctgctccttggatactggcatcagcctcatctgagtgcccacgtgggttcatgctggtcacagcgagggagccctgccctgacccttatgctactct

SEQ ID NO: 79704 - DNA, 824 bp, Homo sapiens
ctgaagggtgtccccgcactgctgtcccccgagctgctctacgcgctggcgcggatggggcacggggacgagatcggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaaaaaaaaaaaaaataaaaaatataagaacacaaattacactacaatacacaaaccctcgcggggggtattattatcgggggggggcggaaacaaggggtatgtatacaggcggacagtgtgaactagcggtgttgcgggacccgagagttttgtgtacacaaaaggggggaaaagcgcgggcccccaataaggggcgccggttaaagttacggaaggcggtgttaccgggtaag

SEQ ID NO: 79705 - DNA, 846 bp, Homo sapiens
gagccctcgcgtctgggctgcccccgaggttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaaaaaaaaaaaaaataaaaaatataagaacacaaattacactacaatacacaaaccctcgcggggggtattattatcgggggggggcggaaacaaggggtatgtatacaggcggacagtgtgaactagcggtgttgcgggacccgagagttttgtgtacacaaaaggggggaaaagcgcgggcccccaataaggggcgccggttaaagttacggaaggcggtgttaccgggtaag

SEQ ID NO: 79706 - DNA, 893 bp, Homo sapiens
ctgaagggtgtccccgcactgctgtcccccgagctgctctacgcgctggcgcggatggggcacggggacgagatcgttcttgcggacttgaacttcccggcctcctccatctgccagtgtgggcccatggagatccgtgcagacggcctgggcatcccgcagctcctggaggccgtgctgaagctgctgcccctggacacctatgtggagagtccggctgcagtcatggagctggtgcccagcgacaaggagaggggcctgcagaccccagtgtggacggagtacgagtccatcctacgcagggccggctgtgtgagagccctggcaaagatagagaggtttgagttttatgaacgggctaagaaggcttttgctgttgtggcaacgggggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaaaaaaaaaaaaaataaaaaatataagaacacaaattacactacaatacacaaaccctcgcggggggtattattatcgggggggggcggaaacaaggggtatgtatacaggcggacagtgtgaactagcggtgttgcgggacccgagagttttgtgtacacaaaaggggggaaaagcgcgggcccccaataaggggcgccggttaaagttacggaaggcggtgttaccgggtaag

SEQ ID NO: 79707 - DNA, 761 bp, Homo sapiens
tcaggagctgcccccatccccaccggggggcctcaggagctgcccctaccctcttctcagcttctgcctggctgaggctagacgtcccacagagtggagagaccagggaggaatttcgggggggcagggcccccatttgcctgagcatcaagtgggtgaaggtggacagggtctgctctgtcccccagatgctgaagcagggtctcggcaccctggccctgcagcccagctcagtgctgggcttggctcctctgcagggagacggccctctacggaaacctcatcctcaggaagggggtgcttgccctcaaccccctgctgtaggcctggtgaagaccacctgggccggaagaggaactgggggcaccctgagctccagtaccaccactcacaacaggcctcccagtggcagctcccagacctgggccctggccagggctctaggggccggcagtcttggggtgggccctgccaattgggacgagtatccctgatttgtgaaaatgatggaaaaacgttcagtctcaaaaaaaaaaaaaataaaaaatataagaacacaaattacactacaatacacaaaccctcgcggggggtattattatcgggggggggcggaaacaaggggtatgtatacaggcggacagtgtgaactagcggtgttgcgggacccgagagttttgtgtacacaaaaggggggaaaagcgcgggcccccaataaggggcgccggttaaagttacggaaggcggtgttaccgggtaag

SEQ ID NO: 79708 - DNA, 335 bp, Homo sapiens
accttgtactttatatactgtactcaatgtaatttgtataacaaagttatactgtattaagccaagtatatttcactctgataattttgagaagtctactatgtcacaaaatctaggaaaatgttaccttagaccctaatctaatcatccttgattgagtcttagtcaccgtagaaatctcacatgatttaaaaaacacaaggataggtagagatttgttaaaggatacaaaattacagcaagataggaggaataagttctagactttttcactggggtccccaacccctgtgccgtagacccatacctggctgcacagctggaggtgagccatg

SEQ ID NO: 79709 - DNA, 659 bp, Homo sapiens
attgggatgattttcaaataatgtgtatatttaatgtggtcattaaaaacatgaaatcaatggcatttcttacaagcaataatatcttgcaggtaaaatgtgattttaagaagtgtttctttaaaaattagttcatgtaattagtatggacacttaagttcgtggtagaaaatagccaattcattcgttcattcaacaaataatggagtgtttacgatgtcgccttggcaacaagggggtaggtgaacagcagtaaacaaaagcggcaaaaatccttgctttcaagcgcctgtcagccagccactgcttcgtgccctgtgcactacctaccttgcttctcaaatcagttgggttattttagggagaataagtattttagccaaggccactcagcgcttaagtgatagaagcagattccaactcaagtctgcatggctttaaaccctgtgttctttcctcaaattaccataattgttgggctaaatgaaactttctcactttgtctcactgacagagctatcattacctgggccctctctcttcccacctgcctcagcactggcttgaggactcaagtccgggaactgttggtggaaatagaaggcatttcagtggatgcctcagcccaggctggtgtgtttttaaaaaaaaaaaaaaaa

SEQ ID NO: 79710 - DNA, 543 bp, Homo sapiens
atactagtagtagaatctaatattccactttcaataatgtataaaacatccaggtaggagatctataaagaaagagagtacttgaacaacactgtacaccagttggactttagggacatatacattacataccactcaacagcagcagaatattcttatacttcagcaacatgttcttctcaaacacaggtggaacatactccaggataaattacatcagacctcaaaacaagtccccccaacattaaaaagataaaagtcatttcaaagatcttttaagatcacaattgagtaaaattagaaatcaatagtgcaagaaagtgggaaattcacaatgacgaaaaaacaatacactcttaaataaccattgggtcaattaggaaatcataaaggaatttaaattatatctcaaggcaagtgaaaacaaaaacacaacatatcaaaacttacaagatccagcaaaagtactaaaaaggaattttgtagcaataaatgcctacgttgaaatctaaggatctcaaatgaacaacctagcttatacct

SEQ ID NO: 79711 - DNA, 1217 bp, Homo sapiens
gcgacagtctattgcactcctgagttactattctatagatgtggtaacacctaggatgaggatcaccagaagtctgcactgttaactcttgaagaataaaggcccaggagcacaatgaagttcaattgaaacatttttatttacctttgctgcagggtaagttgagtttccaatcagggcaagaagggtttctgacctataaaaacaatggttagctgtaaggcatatataaacttttattaaccttggacctgactcaagtaaaaattattacacttatatttactatttaatttatagaagtggcaaactggtgacctttgggcagaatcttacctatagacatgttttgaccccaaaattggaattcattgccaatactgtatttaaaattcagaattcacgagttctagttccacttgaaaatttgagagatctgggaatcctatattcacatttccatctagcaacaggactgagctaaacagtggctatcccctttacctgggtatttgtatatttacaacatgcttagaacactgtttcttgcattagagacaaagcagtatacaaaagtgaaaattttactgccctcacagagcttactttcaaaatgttcttcacttcaccacatccagtccttttccctggctagtctctataggtcttggcatttcctaatgtcaataaatactctgcctttctctaaaactgtcagtctccaacaggaatctcatgaagaactaatccaaacatggtgaggtatgaaatttcatttttaaaggactagatcttacacagtggcatagcagctcctttagctttcttgattttattccccaagaaataaaatcattactgctttgtaaagcatttttagtgatatatttagtaataaaaagccaggtttaagataatgctatttttctactatgtaagacaaccttatgatttacagtaagtgaaactggtaaaaggtaaaatacaaaaaaagcatactttcctctattgatcaagtttgcagtgagtgctttgtttgatatataagagaatttaggaaattctaacccagtgccctgcttttatagattaaaagaccaaaagtagtggctgacatcgggaaggaaacgtgagcccctacctcagtccttgcaccaaaattaattccagaaggatcaaagatgtaatcaaaaatttaaaaaaagaaaccaaaggat

SEQ ID NO: 79712 - DNA, 4309 bp, Homo sapiens
agcgggagccggaggagggggaaggagggaggggagagcggtggcggcggctgcgccgggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 79713 - DNA, 4306 bp, Homo sapiens
cttattgtccttctttattgggagggaggggagagcggtggcggcggctgcgccgggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 79714 - DNA, 4253 bp, Homo sapiens
agcgggagccggaggagggggaaggagggaggggagagcggtggcggcggctgcgccgggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 79715 - DNA, 4016 bp, Homo sapiens
agcgggagccggaggagggggaaggagggaggggagagcggtggcggcggctgcgccgggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctttgctgcagggtaagttgagtttccaatcagggcaagaagggtttctgacctataaaaacaatggttagctgtaaggcatatataaacttttattaaccttggacctgactcaagtaaaaattattacacttatatttactatttaatttatagaagtggcaaactggtgacctttgggcagaatcttacctatagacatgttttgaccccaaaattggaattcattgccaatactgtatttaaaattcagaattcacgagttctagttccacttgaaaatttgagagatctgggaatcctatattcacatttccatctagcaacaggactgagctaaacagtggctatcccctttacctgggtatttgtatatttacaacatgcttagaacactgtttcttgcattagagacaaagcagtatacaaaagtgaaaattttactgccctcacagagcttactttcaaaatgttcttcacttcaccacatccagtccttttccctggctagtctctataggtcttggcatttcctaatgtcaataaatactctgcctttctctaaaactgtcagtctccaacaggaatctcatgaagaactaatccaaacatggtgaggtatgaaatttcatttttaaaggactagatcttacacagtggcatagcagctcctttagctttcttgattttattccccaagaaataaaatcattactgctttgtaaagcatttttagtgatatatttagtaataaaaagccaggtttaagataatgctatttttctactatgtaagacaaccttatgatttacagtaagtgaaactggtaaaaggtaaaatacaaaaaaagcatactttcctctattgatcaagtttgcagtgagtgctttgtttgatatataagagaatttaggaaattctaacccagtgccctgcttttatagattaaaagaccaaaagtagtggctgacatcgggaaggaaacgtgagcccctacctcagtccttgcaccaaaattaattccagaaggatcaaagatgtaatcaaaaatttaaaaaaagaaaccaaaggat

SEQ ID NO: 79716 - DNA, 1887 bp, Homo sapiens
agcgggagccggaggagggggaaggagggaggggagagcggtggcggcggctgcgccgggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtaaagactattactttattttcttatgttgaatgtttatctaagttcttttttttttcttccccatgaactcgtataaatgtgtgggtccatacatacgcttccatttgatctttgctgccatcaacacaatacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtaatcactaaatcacttacatatttttcttttctccagttgctgctaacctattaacctcttgccaagctaaagattcgttattaaaactgtagatgttgtctcagattctgaaagaacatctttccttacactgtttcagagctttcaatctgctccatttgctccattgtaattgcttttaccctaaatgtgatgtccactactgagacgtacacactttcattggggaaagaaaaataatgtaacatggcatttgttccacgtacaagtgaaaaaaagataaaatcttagttatcctgtcctactggattagacatcaaattttattcttttgatgacagtgtcattctataaatttaaaatacataaattactttaatccaac

SEQ ID NO: 79717 - DNA, 1123 bp, Homo sapiens
agcgggagccggaggagggggaaggagggaggggagagcggtggcggcggctgcgccgggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagtacatttctatgaccagaaccacgagcacactccggccgagctacaagctcggaccggtatcactcgccgt

SEQ ID NO: 79718 - DNA, 528 bp, Homo sapiens
ttttttctctgtggtattttacggaaatgtatagtcctttgctcttagagaaagaacccattccagtgttgacttcaagaccataagttatttcaaaactatgtaaagattgacaatccagtaataacctgtcactacacatacccagattttccctgtaaactgtaatatttaacatgaaatgttaaattctgatgccagagttcatcaaaaactaaactgttgcctgctttttgcgtctttattcatttttttagatcagaggcttcgaaactgcttactgcattgatagcatgggaaaaacaaatggaggctttgttgaactaggaccctgccacaggatgggagggaatcaggtaaaccaccttacttttgtgtttaagttgttccgtattgagggccatcaggtttattgatcacagagtgatctttgtactttggttttcgatttggtaattttgtttgttttgataaagtaaaacattctgtaaaaaaattgacagtgttaaaacattcacttaaatgatg

SEQ ID NO: 79719 - DNA, 3227 bp, Homo sapiens
tattgagtggccatgtgaggaggtaagcaggcctgagactgggtagagagatggttttgccagaggggcctgggactggagtttactatggaaacgtattcctctaagccacaaggaaaaggccaaaagaaaacataaaactgaaccttatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 79720 - DNA, 1160 bp, Homo sapiens
  misc_feature (1125)..(1125): n is a, c, g, or t
  misc_feature (1139)..(1139): n is a, c, g, or t
  misc_feature (1160)..(1160): n is a, c, g, or t
agcgggagccggaggagggggaaggagggaggggagagcggtggcggcggctgcgccgggctgtgagtctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaactacatgtactgtgcctctaatagattacatagatgggaatgattattccattgaaccacagcaaggtggggatgacctcgtaactttgaacccaaagaacctgagccttctggagtgggttgtggnccttgaggctttgntgaactaggaccctgccacan

SEQ ID NO: 79721 - DNA, 291 bp, Homo sapiens
aacaagaaagtaggcaaagttctaatactttggtagccagcactggctaaagtgcaacttgttagcagacaatattgaaggtatttcagaagtattttactcgttgccttttactatcaatgtagtgaccatgtgttttgaacagattagtattatttaattcctttggttagacataggaattaaacttcttttattctcaaagtctcacatacttgtaatctcctgatgggctcttcttacccactgcacagataaacccaattcactgagacagtgttattgcagtaa

SEQ ID NO: 79722 - DNA, 562 bp, Homo sapiens
caataatttcatcttatagcaaggagacattccaacgttcccatgttttattttctgagaacagtgggacagatctgtagtaatggaatattatttgcaaaagggttacatatgacacaagtaagtgttctgacataaagttttatttagttcagtggcatgtgctgttgggagccatacaccataaaatatatatatcccaaaataaatctagaatattttcacctccaatttcagtaattggcatatgatttgtgagacgcatctgtttttgtatgaggtttaatcactagcaatctgtttaaagaatccagtcctatacacagttggactcattcttgaaacctttaaatgctccctcatagtttttcagttatttggaagttgcattgggtcaaactgaactccttgagtttggtgtaaattccttttttctgcttattatagtgaaacttcagcatgtttcttagtaaactcccataccattgaaatgcttaagccagttggctttcagtctcatgccttatttcctccaaggcatgcctcaacgcattgtttgtct

SEQ ID NO: 79723 - DNA, 757 bp, Homo sapiens
ctgccctgctctctggtcttttcagtttgcctctttttacggaactgcgtcctacagtggagctgggcacagcaactggatcccagccttcttagcccgctgttcttgggctagagccccatccgatgagtagggactggctggaggaagggggctgtccgtcatgctcaccaggaatttagcctcttcaactgggtgctggggtgagaaatgctggcatctgtccctcctggccctccgacggtggctccgtgccctcaaaagaaggatgatcccttcctggtcccgcctgacccgggggagctcggcccctgctgtgctgtcagcctcgccccggccgcccgcgctgacccccgcccggctcacagcaccgctggccgcagcctctcaccgagagctcctgccctcagcctccagccggagaaggactccccatcccagcagagctcagctcagcgggcacgcgcacgacgcagaaatccttgatttctcaggttaggcgacggctgaattataaacacgggcctcgctggaccacggacccgccaggttctcccgcaacttgcggagctcctggaccggcccttcccagaggcgcagcgctgagtcccaggagcaggacctgaaccaggaaggggaggggcgagcacagtcctgcctcctcctccccgcacagtgctgggggaatgacccccactgccttcttctcctcccccaacactgcagggggaatgacccccactgtcttctcctccca

SEQ ID NO: 79724 - DNA, 418 bp, Homo sapiens
gcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagtaagttaa

SEQ ID NO: 79725 - DNA, 368 bp, Homo sapiens
cttgccggttattgtcagaattttttgttttgtcaacatgctgggtgtgaattgatatcttcttgtgattttatttctcatttctctggtgacaaggtaggttgtatatctttttaaatctttggttttaggaattgaaaatgtcttcattatgtcttttcttcgtctttacctttgtttatggtaccttttatgacatagaagttttcagtatggatttagctagatagcccaatcttttttatgatctttgcttcctgtttcttgttttaaaaattctttgctactctaggaacataaagacctccactacattttcctctgacagattcgaagttgtttccattcttgtgtatttcatccatttt

SEQ ID NO: 79726 - DNA, 2266 bp, Homo sapiens
atggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcagaatgacagtgaagtgttcttatagcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaat

SEQ ID NO: 79727 - DNA, 370 bp, Homo sapiens
tattaacatgagagctacaggcacacaggtattgacacacttttaaaatgtgcatcatcatagacagggctagacagagccaatctggggttgcacctgttcactgctactttggcccctgaaaagttttgtagcaaatcatctggccctgtgttttcagcactgttctgatctgaactcttagtcctctcagtcctttgggtccagctgttggaccacctcagaggcctactctgcattcatgtcctggcacatctgaccctgttgtttgattcaaggcacacctaccatgttctaatacttaaattattgtatagctactaagtaatgtacactaaatgccatcacagagcctagttacagattttta

SEQ ID NO: 79728 - DNA, 504 bp, Homo sapiens
actttttttaatctgagacatttcttctgtcttcctttatcttccatgacattggtatttttgaagcattaaggccaattattttgcagaacgtctctcaatttggagttgtctgatgttttctcattacttaggttttgcatttttggcagtacttcagaagtgatttgtttctcagtgcatcacactggaagacacaagatgttgctttattgcattattgatgttgttcacttttattttggagacaagttctcactttgttgcccaggctgcagtgcagtggcacgatcttggctcgctgcaggcttgacctcctgggctcaagtgatcctaccacctcggcctcagaagtagctgggaccacagcagtacactaccaggccctgctaattttttttttattgtggagacagggtctccctatgctgtccaagacggtgtcgaactcctgggttcaagtgatcctcccgtgtcaggctcccaaagtgctgggattatgat

SEQ ID NO: 79729 - DNA, 817 bp, Homo sapiens
gtttacccaccatttgtatacaggagtacaacagcacagtgtggttgagactacagggcaaacattgtgctaagttagatttcaaagaatttttgatcaggatgcaaaccaagagaccgtttttgaaaacattgccaaaccagttgctgggagtcctacaggaactggatcaacccagcaagtctgcagttcccaaggtcttcaggatgaggcaccagtgcagttatgtagtatttttccgccaaagtgatatgttttaaactgacagattttcattgttccatttgatgctaatattttcttctaacaatagcttttctcttaatgatgccttttacttatgtaaacatgtttttctcataaaaacttaaatagtcattttgctttttattaatggaatcaccaccaagcaatctttataagattgtcatttatatggctacattaaataacacagttctgttttcatacatagaaattctaataatataaaaaattatgtagccaaaaatattgaaacatttatacatgaaaagcttgagtcacagaaacctagggttgaaaggaacttcaaggtctttagccttcctccaagaaatataacttacaaaagtgagcagaagtttttatatattcacttgcccttaggctcttaatttaactccacactgagcattttcgacactgacttgttttgagaaaggttatcataagggagcttttccgtttctgctacctcaaatgcgtgtatcttttttcttagcctttcttcctttactcttctctcagaaatatttctctttactatccttactac

SEQ ID NO: 79730 - DNA, 208 bp, Homo sapiens
gggctgctcctcttctgtgttctgccatcctgaagccagaaggaccaccttggctgctctgtcctgtgcccgacccatccattccaggcccctagctcactttccagatggccctgggtgcaccccacatctccagctcccttggcccaggccccctcctctgcatcagccctgctgtggtttcagccaccctcctcgtctgaggcca

SEQ ID NO: 79731 - DNA, 181 bp, Homo sapiens
aaaataaagatgatttaggtagtttgatagtatagttagaaggaagtattttgcagaggcagtgaagtgtactataatgtagaacatactgttcagtcgtaatcattggtagatttgagcaggaatttccaagtaaattttatttacttacgtatggttggcaatcactgtttcttctatt

SEQ ID NO: 79732 - DNA, 230 bp, Homo sapiens
ggggctgaacgtactaatgtgctatgctcacgtctctcttcctcttataaagtcactagtttcactctgatgataacccattaattcattaaccctttaatatactgatctatgaattaatctattcatgggggtagaaccctcttgatccaatcaccctcaaaggccccacctctcaacactgccacattggggatcaagtttcaacatgagttttggagaggacattc

SEQ ID NO: 79733 - DNA, 430 bp, Homo sapiens
agcaatccagggataacaggttctgaatgagaaattgctgagatgacctttaagaagcagataaaacatgtttaggtgatgaaataggagaggcgcgctctgatatatgtatacgttttgtgtgatatatacacatacatatagatctatacatgtgcacatacatagacacatcttcaaacccacacttacctgtacatgtgtacataatatacatgcactgatccacacatgcccatagcaatctgtgtccctgatactccatgctaccctattttggaatgcttggaaatcagcttgctttgaatttgaggacttcctattacagatggtgccaatgaatgagaaaaaggagcaggaaactgctccaccatcttctaggcttctgagtcatttccgtgttaccacttgctttttgatgatgcatgtt

SEQ ID NO: 79734 - DNA, 829 bp, Homo sapiens
gttgccttgaatggcagctgaatgcaccagcgggatccttggcagcaatgcccaggcactgaagtcgggcattcaggagagctaaatggagaaaagaaacttgagcaaactgcttcctggaacactgagaacctgaatgggaaattaagaagaaccagattctttctattcttccaccagccaaggtgatgagcacaaaaggatccatcttatacagtgcttgccagcttccataatactactcaccacgatgttgaaatcacctgttccagaaccagtcctgtcctttgacaagaaggatttaattatcagtagtggtggggactggctggagagaggaaaaacacttcaaggactctgccacctttcgtagatggagagtgcaaagtttgtaccatggaactccttctctaacagttactctgtggcagtgcctatttcaaacctcccttaacttctgattgtatagatgtttgtttcatttgttcatctgtttgttcacttagtcagagatgttttaagccttaagagaaatagtggactagaaaatgccttggaaaagtacaaagttcaatccaagtaaactgtttttaaactaggaatttatgaagcctaaaatataaaatgtatatacatggatatgctctgaagtgaggtagaggggtagaaatcaacattgtgatattgtactatagttttgcaagatgttaccattgggggaaaatgtttgaagggtatacgggatatctctgccttatttcttacaactgcatgtgaatctacagttatctcaaaataaaaatttaattaacaattgattacaaaaaaa

SEQ ID NO: 79735 - DNA, 374 bp, Homo sapiens
ctctttgttggatgtgaaaataatcttttgggaaatgtgtgcttagaccttgatgtgatgcatagggacaaatttctaattctatttgcttcctaagaaaatgaaatgttactaaataaacagcgtcagggcaaggagtccaggtccataaagaaaaacttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaa

SEQ ID NO: 79736 - DNA, 208 bp, Homo sapiens
ccagctctcctctaaaagcccttttgggggatcgtttcccaaagtgatgggagggtaactaaatgtattccggcacggagcctgcagcagcaaggctgcttgattaagaatgaattacactttcatcagcacagacagaaaattgattcacaaggctgcattgtgatcatcttgttcctaaagcaagggaaggttgggggagacacag

SEQ ID NO: 79737 - DNA, 563 bp, Homo sapiens
tatatgacttaacatatgaggctgcataaacatctctagtagttgtccaactggtgcttctggttctgcctccccagaaagtggatgacctgggccaccctccaccactgccctgtaaggccatgggacacacagcccatcagttctcttcatgtggtcatcccctgttagatgggagaaaatacacctgcctcatttttgtaccttctgtgtgaacattccacgacagaacttcactaaatgtgtgatgaagaactgaatgaatgaatgaatatgagagaaaatgaataaatggctcagatcctgggctggaagtctgtgtatgaggatggtgggtagaggagggtctgtttttcttgcctttaagtcattacttctcattttggggcaggagcacaggctttgaatgcagaccgactggactttaattctggctttactagttgtgattgtgtgatcttgtacatgttacttaaaccctctgtgcctgtttctttatctgtaaaatggagataataagatgtcaaaggactgtggtaagaattaaatgctttaaacaaatc

SEQ ID NO: 79738 - DNA, 376 bp, Homo sapiens
taagatgaagcagtcaacttcactgggtcaaaagttacactggactggacatagcatctcacacctgtaatcccagcactttgggaggccgaggtggggaggattgcttgaaaccaggatctagaaaccagcctgtgcaacaaagcaagacgtcatctctacaaaaaagtaaaataaattatctggacatggtggcatatgcctgtagtcaccgctacttgggaggctgaggcaagaggatctcttgaacccaggactttcaggctgccatgagccatgactgtgccactgcactccagcctgagctttacagtttagagtaagaccctgtctctatataaaaataaataaagttacactgatgctgagtcactta

SEQ ID NO: 79739 - DNA, 829 bp, Homo sapiens
ttaaaaaaaaaactttatctcacgcttttcatcaagagctgtaatcagtgagcctgtgtacttccttttccctgccagatagttgttcctggctggaagacattttatgatatttatttgatgacacacacctgctgagtggatgaaaagcaactgttcctggggatgacctacttcaagggcgcagtcagcttctgaggccttcagcaggttatcctgaaatcattttagttcaccttgatatcacctgttgaacatatctaagactggtgtattcgcagacttgttgtaggcacagttgctaaccccagggaagagatttcggagtcagtaactactttgtcagtgtattgagactgggaagacacgctgctttaccaaacctactctgagcatatggagtgctgttcttggcactcgggatgcgcatcagcccagggacctgccagctgggagcggacccctagaaggggatctagtgggaacataagtaagtatggtccagcacagaagggatggatctgaggaagaaggcatggaggatgaggatccgaggtgagggaaagggccatgaaaaaatttctgacgaagtgttctcctgggagtttccagcacagagagagatttccagttgagatcagggaagagcaaggaatatttgaaatgcatggagacactgtcaccagttcatcctttgaaggcaacatgtcttggcatgttcatttctattctacaaacatttatggaacacatgctgttgagacatggcaggccttaggtagtgaagataaaatataaataatccatgtcgctctcccaacatgtatac

SEQ ID NO: 79740 - DNA, 715 bp, Homo sapiens
ggtagacgagtgtcttacagagcctgtgtgggaagcaaaaggcaagggtgtagttcacaggcagaagcgagctgtgacattgtcagtgcagcgtgtaagtgtggctcctcacaggcggccattgattgtgagacctcatcttgctctgaagatttcccggtggctgtcatgcattgcttctcaaaagccttgcactgtgataaggtttaaggagacagattgttgcaacaatagccacttctaaggaatgttattatgtcactgcagatgatgtttttaagaggtgattcagaatgatagtttcgtgattacggaaaggagttccttctcaaactgcaaaaggaaagatgaaaatagtcatgaagcctccagaactgaaattgggcaccttttatgatggatatttactttaattcaatgcaacacatatttatggggcatagactgtatcaaatacttaataaaacccattcagtttggagctcacacctaagctgcgctgtaattggattttcttaatattcattaaaaacacaaaacaatattattttacttttttttggtatttgcatttgttgcttatagtttgtggggtgaagcaaagtggtgtgaagttgaagaagggcactatgaattaagccacacaaatgcctctaagcactgctaggagatttagaaataattacttagtcctcttaacagccatgtggggtag

SEQ ID NO: 79741 - DNA, 839 bp, Homo sapiens
ggctgtcagtggggcctggtcagtgacatcctggtcagcaggctcctagtcagagggagcccaatcaataaacctggtcatcgggggcctgaaattatccttgaaccagaaaaaaaaatccccaattcaacactccatttttgtgaagagctggttccgaattctgggtcactttttggaaaaaatatctgttgtggtaaacagtgctgcatctgtgatctcaagtctctactggaattggatagagatggtgaatttcagccagagcgcccaaagaactcgtgtcccgcgctcctgaacgccatcagccgccgcacctccatcttccctcctcccacgagtctcctgctccccgtgactctggcctcctcgcagtgttgctgggccacgtcaggaagtgctggaggacgtggcattgcaccaacaccaggcggccagccgtgtggctcatcccgcaaatcaggctcttcctgtgcatggagatggagtccctctggaggcagcccgtggccctgttctcgggcaggtggagcatggagacgactgggaacttcactagacacgcatccagccggttcaagggcttgtcgcgccgtgcaccagcttgcaggagaaagcccaacgcctcgccaagcacgaaggcctcccttcccgacttgatgaaggcagagtagcggttgaggttgcggctcacagtgaccgagctcctgcccacgtggggacccagggagccgtcgagctccagcccaggcttggacctgaagaagctggaaccgcgaacgccaacagggacagtcgaaaaaagcaaaagaaaaatcccaacaaaatcctgtctccct

SEQ ID NO: 79742 - DNA, 1214 bp, Homo sapiens
ggctgtcagtggggcctggtcagtgacatcctggtcagcaggctcctagtcagagggagcccaatcaataaacctggtcatcgggggcctgaaattatccttgaaccagaaaaaaaaatccccaattcaacactccatttttgtgaagagctggttccgaattctgggtcactttttggaaaaaatatctgttgtggtaaacagtgctgcatctgtgatctcaagtctctactggaattggatagagatggtgaatttcagccagagcgcccaaagaactcgtgtcccgcgctcctgaacgccatcagccgccgcacctccatcttccctcctcccacgagtctcctgctccccgtgactctggcctcctcgcagtgttgctgggccacgtcaggaagtgctggaggacgtggcattgcaccaacaccaggcggccagccgtgtggctcatcccgcaaatcaggctcttcctgtgcatggagatggagtccctctggaggcagcccgtggccctgttctcgggcaggtggagcatggagacgactgggaacttcactagacacgcatccagccggttcaagggcttgtcgcgccgtgcaccagcttgcaggagaaagcccaacgcctcgccaagcacgaaggcctcccttcccgacttgatgaaggcagagtagcggttgaggttgcggctcacagtgaccgagctcctgcccacgtggggacccagggagccgtcgagctccaggtatgcacctctgcccagtgcacctggatcgttcaccgtcatggagctgccatcccacttgtcgtcccagtcatcatcactgccctagctggcctagttgccaccaaggagctgctgaggccacggcttcagggcatccctaccgcctggaaatcctgcgctggctgctggaaggcactctgtggtggcaccagctgcggctgcagtagcagctggaaagcactgagagatggcttcaaggaggcaggcagtgcaccgggcagggccttgaaacctctgggtggtacaatggccatggcacagtgggtcaaggcacaggggcagccatggcgcgctgggccagtccagggttgcagaccacttgcactgcagatataaggccagggttgctgaggccatgagcccctgcgagtcagcccttgatgtcctgctcactacacaggctcagcacttcatgttctcatagatc

SEQ ID NO: 79743 - DNA, 665 bp, Homo sapiens
cttccaggtcataagtaggtaagagacaaactgttgcattctttcgagaccttgatcggcctcccactgaaacacaatttagtctggctcagggaatctgtatttttatatcaacaatagggcagaggaagccatcagatatggatttgtctcaggggagcagagggatggctttgggtcctgtctgtcatttgtctacgaggaatttccttctgggcaaattttgagggaggtggtggctttttagtctccgtagccatcttattcaggagtggactgggaggcaggtttgcctgagcagtacccagcttgactcttcccttggcttggtaattttggggcctgagatggattttcctttcacagggtgtagcaggcttagtgccagggcccagaagacttttaggcatcaggaaagtggtttaatgccttctaaaatcagaataaacacagtgcagcctgggctatagtcatctttctaccaacgcagttatgaaacatcattggtaatactttagcccagaggaggggcccacagaggctgtaatgccaggctgcccgctattcccaatggaggctggtcggaggacgtggctcagagtgaaggccaagggggccttccctgaaccccagagtggaggggccacctgcccaaaggcgcagcc

SEQ ID NO: 79744 - DNA, 634 bp, Homo sapiens
cattactctagaaagttccttcatatgaaaatatggaatgcctcatgaatttatatgccgttcttgtgcagtagtatttatagaaaaaaaaaaaggtttaacaaggcttgttttctctaaaaaattacctggtcacaatagctctcttttttagtgtgctgaaggaggcagctgaattatacataaagttgagatggtcatttataagattcactagaacagggttctgcaaactgcaaatatgtctgccatctgattttggtgaatgaagttttactggaacacagatgaagaaaacctgcttgatatcacacagtcaggagtcaactgagttggggctttgaacttaggtttatctgatgccaaagtttgtgatgctcttcaaccatttagggtaccgcagagtgtggattttgaatcacctgcatcagcatcattttaaaatatagattctgtggtcctgaccaggtctctgaagtcagaatatgaagtggagctaggaatctaacttcttaacaagttccctagatgcctaagggtatccctgaatgatacagtttgtttgaaagactgaaaagcccaaagctggcccttttgggaaatagcagtaaatcattgatatgtgaaggttccc

SEQ ID NO: 79745 - DNA, 836 bp, Homo sapiens
cttctttgttctgtcagccactatagagttgaaagcaaatatggacatctgtgttactttgatattcagaattctatatctgtgcaactcctagaaatgcatgttctcaaagagagaacagttttttttaggagatctgttgcccctttttggttctttaaaatgtattgtattatgaagtgcttcttttttcaatatggggggaaaagaaatagagacagagctggggggggtggggggaggagagagagagactgcttcctttgcttaatgttataagttttatacacaactgtactgttatttcttgcaagtattcttgtatttcattaagagaggtaatttttaaagtgaggccaggctaaatattatcttattatcttatacattgaaaagtacaagatattctaagattaaatttcggttggttcttctctaggaatctacatatgtactaattaataccttgcttgcttattaccaagttcctctcattttacatttatgcaggcttcagtcagagcatcctgcatttaaatcttggatacaagcttcttcctcctgacccagtttaatgctacaagtatgaagggtgaaggagagtactttgcatattggagtcacttgggacttgtgtgggaaggcttttgttttgcctaatttcacaaggtgacaagagttcactcctcagctggaagataaacttagataaattaactgaaaaccatttttcactctttctcacttcacctccaacacactttccttttagaatggcttctgcctgttcctttaagttcctccacttgccaaaaaaaaaaaaacgtagatgacgc

SEQ ID NO: 79746 - DNA, 765 bp, Homo sapiens
cccgtctctactaaaaatacaaaaaattagccgggtgtggtggcgcacttctctagttccagttactcggaaggctgaggcaggagaatcacttgaacccaggaggcagaggttgcagtgagccaagattgtgccattgtactccaccatgggcgacaagagtgaaactccatctccaaaaaaaagaaaattacgctaaatatttttgttcagccattttaacatatattaaatgtaaaatctagtatgtttattgagttaattatgagtaaataaatgtaaaacttggattgtgttgtcagctttttaaactcttatttcagtattaggtatattcagatgcttacaaagacatttttagacaactgagcatcaggatttatcacataggtcaaaaatttaaataaacaagtggctatattatgtggcccatgtgtggagcagttttgcttttgttcagtaacagatgaattaagagccttgcccaggaatcttggttcaggatgggtggtctacacatggtctgcttgttaagtaccagtccattatgtgccaggtagtgattcctatttcagagatgagaagagaaccatgagaaaaagtaggcctgtgtaagattaaaagtaagactgcaggcctggtgcagtggttcacacctgtattcctagcactttgggaggccgaggcaggcggatcacttgaggtcaggatttcgagatcagcctggccatggtgaaaccccatctctagtaaaactacaaaaaa

SEQ ID NO: 79747 - DNA, 504 bp, Homo sapiens
taatagacaacctatagaatgggagaaaatatatgtaaattatacatctgacaaagaactaatatccagaatctacaaagaactcaacaagaaaaaaaccaaccccacaagcgggcaaaggacatgaacagacatttcccaaaagaagacatacaagcaacctaaaataatctaaaataatttttaaaaagaaaaaatgcttgacagagttttgatagtacttagtaaaaagttatatctagtggctttttgtttgtttgtttttgttttgtttttaagaaatagtctctgtttcccaggctggagtacagtggcgcaatcttggctcactgcagcctcgaactcctgggctcaggcgatcctccggcctcagcctcccaagtagctgttataggcatgcaccaccactcccgactaatatatctgctatcaataacataattgtttccctttgtgcttatttaggaaataaacacttttatgcttttgatttttatgttgtga

SEQ ID NO: 79748 - DNA, 1016 bp, Homo sapiens
agtgagactccatctcaaaaactaaactaaactaactaaataaataaaacaaacaaaatcttgaaaaaattaaagaattttatctatctaaattcccctttccttctccctaacacgaaaagctctatcctgttaaccatgttttgaaactccataaaccaacacatacatggttagttgattttttttttttttttaataatagagatagggtttcaacatgttgcccaggctggtcttgaactcttgggctcaagcaatctgcccacctcagggtcagctggtttttacaaaatggcaaagacaatcaaatggataaatggtagtcatgtcaacaaatggtgttgcagctgggcatggctgctcacgcctgtaatcccaacactttgggaggctgaggcaggaggatggcttgaggccaggagttcatgaccagcctggacaacatagcaagaccctgtcactaaaaaaaaagaagcagcagctgtgtgtggtgctatgtgcctgtagtcccagctacttgggagcctgaggtgggaggattgcttgagtttgaggctgcagtgacctgtgattgtaccactgcactctattcagcctggttgacggaggaagactctgtctcaacaacaaacaaacaaacaacaagtgatattggaataactagtcgtgcatatgtttttttaaaaaagagagaaccttgaccacctctaccttacaacttaacaaaagttatttcaaaatggatcatagacctaaatccaacctcaaaattaaaatacttcccgaaggaaacatagcagaaaatctttgtgagcttagattaggaaaaaagtttcttagatatagcttctatatccatgaagcataaacaaaaacatatgctaaactagatttcataaaaattaaaaacatctgattttcaaaagacactcttatgaaaatggaaaaacaaaccacaaactgggaaaaaatgtttgcaaggcacataaatgataaaggacttttattgagaa

SEQ ID NO: 79749 - DNA, 826 bp, Homo sapiens
tagagttatacaaagtcttttgtttccttttctctaagaagagttatttctgtttgaaagaggtctttaagcttgtatttcaaacaactcccggcaaatatctccctagttaagtaaatgcagagatagccaatactaaaattcatctgtaaagtgatcatactatgaatttagctccttctcgggttgtgacttgaagagtttatgattcagtgtttcccagttgtgatatactgaccattaaaaccttggaagttggtgttaggaaacccacagcgtggtggtttatagcttgccgtgctttgaaatattccctatcatccaatttcaaaagatacttctaagctcatgggagcaaatgtcattacggagaagctttcaaaatcatctagagataaaagagtcactctgctcaaacaaggaaaacccaccacaacagtgagctagagccactaatctcattgtgtttattttaatcagtacctcctctcataacaaataatcctgatttttcatttgtggtagttatgtaaaagttctggttaaaatgttcatttgaatattagaaagtcagttgattgtaagaaaacattaagtaaaaataatgtgtgaatatggcaaaatgtgaagacagcatgctgatgactgggaaaaatctgtctaaatacacttttttccccaaaggaagaattattttaaagaaaagttggtagggcatattttaagactgtctatcttcttttgaaggaaaatcacttagcttaagtggaacattaggtttcctgtttcctgtcatagtttttctaaattacattcagtacagcaa

SEQ ID NO: 79750 - DNA, 501 bp, Homo sapiens
caacagttagcatcttatggtacaatttgttttacctctgacctctcctcaccctgacttatatacatgaaatttaaataagtgtaagtgatttcgtgctgtgtatctcattgtgatccttactattttatttcatataaccttaagttttaaactttatttatgttgccatgtttttactgctgcttactgctacatggtaatccacagtatatggcagccatattttcactacccattttcctcagtgtttgccatccaaattgctttcaatttccttttaccacatgttcatcatgtcctatcgtggaactttgcaaggatttctttagaatatatacccaggagcagaattgctgggtgacagaatatatgtttatgattaatttaaccaatccctatcagatgcgtccccacataaatactttggtctttacagactccagcaataaccttctcatcatccatgccagcccttaacgttttccagcttactcatgt

SEQ ID NO: 79751 - DNA, 287 bp, Homo sapiens
gtctgagcaagcgtgggcatgggacaccatccaggcaagcagcatgagtaagactcgtggagaagtgtgtgcttgtggtctttctgtcttcctgggctttgctgggggcccattggagtggccagtggggcctcgttgtcacagctgacacagagcagggcccaggccacccggcttctctctccctgtggttgtgagcgccggggtccttgggccgccatagagacaggccagacaggctctggtcatctcagcggatgcctccgagccgcctttcccttttgaag

SEQ ID NO: 79752 - DNA, 554 bp, Homo sapiens
tatttgggcatttaggcaaaaacagcaaatgacatatacaggaaatgattagattaccatcagtcttttttgacagaaacatgttttttccaaaaggaaatggaactacataattaaggaaagaaagaaaaagtgagccaaagaatttataatatatccagcaagactgactttaaagtataaaggacacaaacaaactgttgtgaacatgcaaagacctcagaattttattcccctgagcccttcctgaggaatctatgagagaatgaatcttagataatgaacataatgagagaaccatcactataaagacagagagcagtaaacatgcaattacttgtggaattaagactgaatgagggttaaaggtagagggtatagtttgtaatgaatgtatgcccagatggtagatatagtatgactataggataaagtaaatgaaaacttacgggattctggaatgctagtatactctatgtccttgagaccaagattttcaaaatagaagaaaggagatacagatgtaatacagaagaggttaagtaagtttttaa

SEQ ID NO: 79753 - DNA, 427 bp, Homo sapiens
tgagaaaaccaaaagcatgaaattctgaagactggagatgacttaacaagaaatgacagttatagaaatcaatgacttgactgaggattatccaagaatgagccttcccagtgccaagggatgaaggcctaagagattgatcatcactgcttccatgggaagattttttataaacaggagaaatgaggaaaggaaaatagctccgagcagtctgaagtctgcaaggtgtgcagggccagagagacatgagtatgtatatgatgccacactatgcctaggaaaagtttagtccttgtgcccctgactagctgcctcgcccattatcttcatgttcctagaatttgtaacacaaagaacaatgtacaacctataaatagcttatgttattttaatgtaaatttttggtaaacaactcaggaactgcctc

SEQ ID NO: 79754 - DNA, 192 bp, Homo sapiens
cagcagtggcgccggacgcggcggcagtgaggggccggtgaggcgctgggtggggcgggggttcccggatttcgcaaatggaaatgcaggactcctggttaagtttccagcgcggagaaacacgcatactttctgagtggtgtcctctgcaatatccgggcagcggagcgcggcaggacgcaccggcgggca

SEQ ID NO: 79755 - DNA, 1228 bp, Homo sapiens
aaaatttatttttgacacctaatgtacatatttatggggtgcaatgtgatgtttcgatacatgtatacattataatgatcaaattagggtgattagcatatccatcacctgaaacacggtgtttttgtggtgagaacatttaaaatcctctcctctagctattttgaggtacacaataccttattagttttttgttttttaaaacaagatcttgctctattgcccaagctagagtgcagtgccatgattatggctcactgcagccttgaactcccttgttaagtaatcctctcacctcagcctccttagtagctggtactacaggtgtacaccattgtacccagctaattttattatttttttgtagagttggggtcttactatgttgcgtgggctggtctcagactcctggctagcattaagcgatccttctgcctcagtctcccaacatgctggggttacaggcatgagccacagtgcctgggtccacagtaccttactgttgactgtagtcactctgctgtgcaataggataccaaatcttactccttttttctcttttttgagacaggtacttgatctcacccaggctggagtgcagtggcaggcgtgctcatagctcactgcaaaccttaaatacctggggttaagcagtcctcccaccttagcctcccaagtagctaagactacagacatgcatcaccaggcctggctaattttttatcttttaaaatattgacataggggtctccctatgtcacccaggctagtcttaaactcctggcctcgaacagtcctatctcaggctcccaaagtgctgggattacaggtgtaagtcactgcactgggcccctcctgtctaattgtaactttttagctgttcaccaccttctccccatccctcccactaccacctccagtccctggtaaccactgttctatgtactattcactacttatagatcaacgtttttagacttggcatgtaagtgaaaatgtggcatttgtctttctgtatctggcttattttcacttaatgtattgtcctctaggttcattcatgttataaataacaggatttcattctttttaatagctgaatagtgttcctttgtgtatatatatcacattttctttatccattcattcactttgaacacttaagtcagttatatcttggctattgtgtatagtcctgcaataaacatgggattgcagatacctcttc

SEQ ID NO: 79756 - DNA, 910 bp, Homo sapiens
gtcaaataatttcagtggaaactgcatggcccgcgaagatgaaaaccaggacctgtggtgttatacgcagaacccggtgaaaaatgagaatgcaaggcccctttgaaaaattaagaatctgaagacagtgatggcaaagcattaaaccaaggttgggccccttctaaatgtggggccctgcgtgactgtaatttgctcacccttgaagccatccctgcctaaaatatccactatctggtcatttacagaagaaagcaaaaattgtgggtcctgcattaagagcagagctgggagtgagatcttgggcttcaggggcatcagcctgatgcaggactacagatgcctcaggcctgagtgtaatcaaaagataccaagaaacgaggttcatgtaatttaccaaggactagtgttggtttagttcctctttcttctttcatctttgttgagttttctgtgctcagcgtgtccttaatggtcattgcagcttgctccatttcattggagtgttttaaaccctctttcttgcagtttccccgagaggatgtgctcctgtttgatgtccgtcccttacagtatgttattgtagcacatgcactctggcagaagggctagttgaaacgcgatgctgttgtttttaagctcctagaagtaacagtgctaattgggattgtgatcaactgtgcttgcccaggaccatcagggggcaaggaccacatgggggtcatggggaaggtggttctttattacctttgttatggctgcaacccttctaggctagctatagtgtttggacttgtagtcaaatataatcctgcattaaaatcaaacaggcagtagcattccaaaaagtctactgttacgggctgtattctgtcttccctgcaaattcagatgttgaagtcctaacccc

SEQ ID NO: 79757 - DNA, 348 bp, Homo sapiens
tggtgtacacaagtagacacaaggatagaagaacatggagagacagttgggcttgataggaaataagaatcccagatgttctcaacagttaataatttatctacatactgtaataaaatccctgatgtcctgtagatactcactaagctttataaacttggttaaaaatacactcactttttccaacagaatttttagaaattatttcctcgcaaatcaatctgattataaaatctaactttaagcttgattttaccatggtaaagctaactttaccataaccatcatccgctctggacaataccaaggaaaagacctatgcattatatgaagttgtacacactccat

SEQ ID NO: 79758 - DNA, 5548 bp, Homo sapiens
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatgggaatcctgcaaaacctggcagctatgtatggaggcaggcccagctcttcaagaggagggaagccaagaaacaaagaggaagaggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacatgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgagatggagaaacatgccatttttcaatgaagattctaatattttatctattttgttcattgaattccatggtttctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctgaagtatat

SEQ ID NO: 79759 - DNA, 2231 bp, Homo sapiens
  misc_feature (317)..(317): n is a, c, g, or t
  misc_feature (1586)..(1586): n is a, c, g, or t
ttcatttactattttctttttcctcccatttaagatgtccagtaaagaaagagaagaatcaaggagagaagttgcagtattggcaaacatgaagcatccaaatattgtccagtatagagaatcatttgaaggtcagataaattatgcgagagagttaaaaaatcctaagacattaataaatctttttgtgaatgcattcttaggaaaaagataccatttttgcttaaaaacatacgcatatgaatatcagcttgattcaaggacaatactgatatcatgcctgcatttttttttttttttaaattgagacagtctcnctcagtggcccaggctggagtgcaggggcatgatctcggcttactccaacctctgcctcccaggttcaagtgattcttatgcctcagcctcccaactgtgcctgtataatttaatactggctgttattagtgattgctttaaaagaagcaatgcagtaagtgcaagaatttggacagagcaagaacagtaatttacatattttttaactgaacttcctgtaagtgctgccaccactaccactgagaaaatgttctgatctttagaaagtatcctcactcagtatgctcctctgtacctcactattataatagtgaggtatgttgaaagttttctcaggttcttaaagtattatagctataatgctgttttggaactatatgcattatatttaataatgcaggtattaagataaggcaaagcttctctaaaggcaggtcaaagtggtttattgaagtcctacccaaatattctcattattataaatttctgtaacttaatttctgtaaactaaaaaccaggtaatctagattgaaagtagaagataattgaaatgactcagggacatatcacataccagtttcagagtctgaattagagctaaagttactacattcccagatgaactctgtgtctactataagtctcttctacttttataaaaatgtgattcaattaatacattatgtcacaaggtactgtattttttatgctggcagtgaaatgaagatttatatttcatgtgaaagagtacaaaattaaccaactcttccttttcaggaccttgaattttcctttatctttctcctggcatctatcctttagtttctttttttgttgttgttaacaaaattttaatatttcaagttaaaaggttttgagcaaatattccagcagatgttttggatttatattgactgcttcacatagaaacatctgtgtgattcaaaaggggtagcgtattttaaaaataaggctttattatttctcttagttttagaagaatacatgctagcatcaaacataaatgatagcatagtatatgtaattttttgctttttgttatgctacatacattataacatctatatacatataaatagtgaattatagttttcaggagtttttttcacattataatttctcacatgtatatttggatgatctttccaggtcaatcataaaaagtcatacagattcttaattagctttatcatatagattcttatcccagtggcacattacaaacagtagatcaaaagaagatatgngcaccacgagtgacaagaatgtcaccacaaagtataagaaataaatactcctggaggctggatgcggtggctcacaattgtaatttcagcaacttcgggaggctgaggtgggaggatctcttgagcccaggaatttgagatcagcctgggaaacatagggtgtttgtagaccccatctctacaaaaatttaaaaaattagccaggtgtggtggtgtgtgcctgcggttccacctactctggaagctaaggtgggaggtttgcttgagctcgggaggtcgaggctacagtgagccatcatcgtgccattgcactctaacctggaccctgtctcaaaagaaaaaaaaaatactgctggaaataaggccatagcacagtcagtgaaagaagtgagaactaggaaaactgttctttgagttgtgatagtctcagtactatgtagtgattcagaaaatgttaaaagtgatattggccactcttccttacttaagaagtaagggatggaaagaatcatcaaagtgttcttctaagctggacacagtagcatgggcttgtagtcctagctattggggaggctgaggcgagaggttcccttgagcccaggagctcaaggtcagcatgagcaaaatattgagacactttttctt

SEQ ID NO: 79760 - DNA, 964 bp, Homo sapiens
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgaggacacattcagctaacgtattttagcaggtggagtgaggttgaagattcctgtgacagcgatgccatagagagaatgtactgtgccccagaggttggagcaatcactgaagaaactgaagcctgtgatggtggaagcttgggtgctgtccctctttgaacttctcactggcaagactcctggttgaatgccatcccagcaggaattaattctcacactacttttgaacattgccagaaatggtgtctcctgaagaaggctccggtccaatcattccaacaggctcttggcagttcaatccctccgggaacgacactggtcgctggacattggccgcctgttgaaggcatttcactctcatccattcttaccccggggcattgggccgaactcgtggcataaccgtatggggagattcccccatctggt

SEQ ID NO: 79761 - DNA, 598 bp, Homo sapiens
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctggtagaacgtgtaggaggaaggcaggctaagctggtagggcagctccctccctgcatggcaaccctcgtccggtttactagcggagtgactcgagaacaccaggtattgtatcgttctacgatgcgcgtggtatgttgtgcgaaccatgtactgtaccggagcgatcggcgccggagtaccagggacgggacgtctccaaataccgcggtgggttagtccaacgtgcagagcatcggagctgctaccaggctgtagggagcacgtacttcgaggggacccctatgtcaagtcttggtacttgtggtagcctcgcttgcttggcttagaacgagactttgggtttagtctttcaggatg

SEQ ID NO: 79762 - DNA, 289 bp, Homo sapiens
tatactaaatttattaaaaaataaagtaattgctctacagtgtatgtcagtcaccgtgtcactaggtgataggaatttttcagtgtcattataatcttatgggaccagcatcatatatgcgatctgctgtagaccaaaaacaacattaatgtggcacatgactgtgtctttaacttctccaataattttatttttcttctagtactgtagagctggctcgaacttgcatagggaccccatactacttgtcacctgaaatctgtgaaaacaaaccttacaataataaaag

SEQ ID NO: 79763 - DNA, 339 bp, Homo sapiens
gacatacagtgggagaagttattaaattaggtcctaatggatctccaagaagagcctgggggaaaagtccgacagattctgttctaaagatacttggagaagctgaactacaacttcagacagaactattagaaaatacaactattagaagtggtaaggagaaactggtagtttttctatactagaagtaatattattaaaaatctaattatgtattttaagatgtttccattttaagtgaattatttttaattatctttctcttataataattttttaattagattgagaatgattgtgttttctagggggattgtccaaatggtagtcttgagtttt

SEQ ID NO: 79764 - DNA, 5674 bp, Homo sapiens
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggtgtggagagtctcagtgccccctttcagtctggactgtgagctgctgctggttagacagtcttggtttctctttcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaagaggaattctgcctggagttcgtccaggatttccttatggggctgcaggtcatcaccattttcctgatgctgatgatattagaaaaactttgaaaagattgaaggcggtgtctaaacaagccaatgcaaacaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacatgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgagatggagaaacatgccatttttcaatgaagattctaatattttatctattttgttcattgaattccatggtttctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctgaagtatat
